United States Patent 11,098,302 (IDENTIFICATION OF POLYNUCLEOTIDES ASSOCIATED WITH A SAMPLE) - sequence listing, part 13

SEQ ID NO: 42024 - DNA, 531 bp, Homo sapiens
  misc_feature: GYAE6OF02H7IK2.33.63.F08.1.454.CMB.1.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtccaccatcacttggccgggcgagtcgggactatttactaattttttggcctggtatcagcagagagaaggggaagttcctagactcctgatctatggtgcatccactttgcaatcgacggggtcccatctcgtcttcagtggcaggtggtattgggacagtatttctactcctcacccgtcaccagcctgcagtactaaagtnttttnactaacttattactagtactaaaagtntagtacgngtcgccgtctctacgtttcggccttacgggacctaaaggtcggtaaatacgaaacgtactaggtcgactcgaccaccgtatcttacg

SEQ ID NO: 42025 - DNA, 707 bp, Homo sapiens
  misc_feature: GYAE6OF02JI68N.33.63.F08.1.454.CMB.1.raw
  modified_base (195)..(195): a, c, t, g, unknown or other
  misc_feature (195)..(195): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgctatcaggtggganacaggagtccaccatccacttcggccgggcgaggtcggactatttactatttttcggcctggtatcagctagagaaggaaggggtaattccgtagacctccgtagagtcgtagtggtcgctacgttcctatttagactaagtcggtacggggtccctaagtccgttcgtacgttcgacggttacggcgtaaggtcggtacggtttagggaaccgtaggtacgtttccaaccgtttcctaccgtaccggttcctaaccgtacgtccgttacgacgtaacggtacgtaaaaggttacgtttttacgaaccttaaactttacgttaacgttaggttaaactaaacggttacgtacggtaaacgtcggttaacgggtcccgttaacttaccgttaaccgttacccggaccggttaccgggtaaccgttaaacgggtaacggtaaacgttaaccgtaaaccggtaacgttcggtaccggtacgaccggtttaaccgaacgttaccgttcgttaacgg

SEQ ID NO: 42026 - DNA, 549 bp, Homo sapiens
  misc_feature: GYAE6OF02GDBY4.33.63.F08.1.454.CMB.1.raw
  modified_base (219)..(219): a, c, t, g, unknown or other
  misc_feature (219)..(219): n is a, c, g, or t
  modified_base (333)..(333): a, c, t, g, unknown or other
  misc_feature (333)..(333): n is a, c, g, or t
  modified_base (423)..(423): a, c, t, g, unknown or other
  misc_feature (423)..(423): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggngagtcggacatttacaatttttgcctggtatcagcagagagaaggggaagttcctagactcctgatctatggtgcatccactttgcaatcaggggtccatctcgcttcagtcgnagtggatttgggactagtatttcgactctcaccgtcaccagcctgcagctagaatattttagctaacttatttactagttacaaaagttntagtaactaggttacggcccgtcttacgtaaccgttttccgggaccccgttagggaacccgtaaagggtcgtaaaacgtaccgaaaacggtaacgtggtacggtaccttagccctaacgtataccg

SEQ ID NO: 42027 - DNA, 519 bp, Homo sapiens
  misc_feature: GYAE6OF02F8WU9.33.63.F08.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (423)..(423): a, c, t, g, unknown or other
  misc_feature (423)..(423): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctccctgtctgcatcagtggganacagagtcaccatcacttgccgggngagtcgggacatttacaatttttggcctggtatcagcagagagaaggggagttctagactcctgatctatggtgcatccactttgcaatcaggggtcccatctcgcttcagtgcagtggatttgggactaggatttcaccttctcaccgtcaccagcctgcaggctgaagtatttcgactaacgttatactagtacaaaagtntagactagtcgcccgtctcacgtttcggcccgttaggaacctaaggtacggaaactacgaaacgtaactggtcggacttcggacctaccgattccg

SEQ ID NO: 42028 - DNA, 670 bp, Homo sapiens
  misc_feature: GYAE6OF02G56YG.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttcggccgggcgaggtcgggactagtttactaattttttggccttggtatcagcagagaggaaggggaagttctagactcctgatctatggtgcatcctactttgctaagtcgacggggtcccattcgtacgtcttcgaggtcggcgtaggtcggtagtttggggaactagtactttcgacttctaccgacccgttcacccgacgtccctagccgtacggtctaaggtaagttactttttacgaccttaacttttaactttaaccttaggttaaacctaaaaaggttacgtacgaacgtacgggttaccggtaccccgtacttacccggttaccgttttcccggggacccgtttaacggggaaacccgtaaaaggggttaccgggaaaaacttaaccggaaaacccggttaacggttacggttaccgggtcctacggaacccgtacccgtaagtttccgg

SEQ ID NO: 42029 - DNA, 613 bp, Homo sapiens
  misc_feature: GYAE6OF02H0HQR.33.63.F08.1.454.CMB.1.raw
  modified_base (467)..(467): a, c, t, g, unknown or other
  misc_feature (467)..(467): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggactatttactaatttttggcctggtatcagcagagaggaagggaagttctagactcctgatctagtggtgcatcctactttgacaatcgagggtccctatctcgtcttcgagtggctaggtgtagtttcgggactaggttactttcctactctacctaacccgttcaacccgagtcctgacacggtcttaggaaacttagtttacgacttaactttaattactagttaacctaaaagttntacgtaacgtaggtaccgcccgtacttaccgttaccgtttcggaccccgttagggtaaacccgtaaagggttaccggtaaaactaacccggtaaaacgtaaccggttcggttacggaccttacggaaccctacccgtattacccgg

SEQ ID NO: 42030 - DNA, 568 bp, Homo sapiens
  misc_feature: GYAE6OF02JXXX5.33.63.F08.1.454.CMB.1.raw
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggagttccgtagactcctgatctatggtgcatccactttgcaatcaggggtcccatctcgtcttcagtgcagtggatttgggacagtatttcactctcaccgtcaccagcctgcacggctagaagtattttcgactaacgtttattacttagtactaaagttatagtaacgtacgttacggacccgtcttaccgtaccgtttccgggtacccgttacgggaacccgtaaaacgggttacggaaaacgttaccgaaaaccgtaacgttacggtacgggaccttacggaccctaccgtattaccg

SEQ ID NO: 42031 - DNA, 822 bp, Homo sapiens
  misc_feature: GYAE6OF02IZ2F8.33.63.F08.1.454.CMB.1.raw
tcagtacacacactcacgaccggtgctcgatttagcgatcgtataagggggcgagaagtctctctcagtcaggacacagcatggacatgagggtccctgctcagctccgtgggactcctgctgctctggctcccagataccagatgtgacgtccagatcgacccagtcctcctactcctccctgtctcgactactcgaggtgggaagacgaagtacgtccaacctatcctacgttcggaccggggcgtacggtccgggactagttttaacgtttaagttttttcggaccgttggtacttacgtacggacgtaaggacggaagggtaaaggggtaacgttaccgtaacggtaacctccgttagtacttacgtaagtggtcgtactacttccttacgttcgtacctaagtcggtaaccggggtcctacgttccgttcgtaccttcgtaggttcggacgttaggttggtaacgttttacggggaaccgtttaaggttaccgttttaccgtacctttcccgtaacccggtacccgttaacccgacccgtacggttacccgtacgggtaccgacgggttaccgttaagggttaaacgtttacgtttttacggaaccttttaaacgtttacgtttaaccgtacgttaaacgttaaaacgttcgttaacgaacggtttacggcccggttacccgttaccgttaccgttacccggtttcccggtaccccggttacgggtaaaccgtaagggttaccggttaactaaccgggttaaccctaaaccgggttccgttagggtccggtacgtaccggtacccgtacttaaccgg

SEQ ID NO: 42032 - DNA, 628 bp, Homo sapiens
  misc_feature: GYAE6OF02H8JV5.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagagtcaccatcacttgccgggcgagtcgggactatttactaatttttggctggtatcagcagagaggaagggtaattcgtagactcctgtatctagtggtgctatccactttgactaatcgacgggtcccatctcgtcttacagtgcgtaggtagtagtttgggacgtagtactttcacttctacgtacccgttcaacccgagtcctcggccaaggtacttaaagttcttttagaccttaaacgtttacttaacgtagttaactaaaacgttattacgtaacgagggttccgacccgttacgtacccgttaaccgttttccgggacccgttaacgggtaacccgtaaaagggttacggaaaacttaccggtaaaaacggtaacccgtttgggtacggttacctacggaccctaccgttacttccgttaacg

SEQ ID NO: 42033 - DNA, 550 bp, Homo sapiens
  misc_feature: GYAE6OF02GRYYP.33.63.F08.1.454.CMB.1.raw
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgaggtcgggactatttactaattttttggccttggtatcagcagaggaaggaaggggaattcctagactcctgactctatggtgcatcctactttgcaatcgacggggtcccatcctcgcttcgaggtcgcgtagtggtagtttgggactagtactttccacttcctccgaccgtcaccctagtcctgcagtactaaagttnttttcgacttaacttattactagtaataaaagttntacgactagtcgcccgtctactacgttccggacctaggaactaagtaggtaaactaccgaaacgtacgtgtacggtctcgaccactactctacg

SEQ ID NO: 42034 - DNA, 521 bp, Homo sapiens
  misc_feature: GYAE6OF02FY394.33.63.F08.1.454.CMB.1.raw
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
  modified_base (515)..(515): a, c, t, g, unknown or other
  misc_feature (515)..(515): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactctgatctatggtgcatcctactttgactaatcgaggggtcccatctcgcttcgagtggcagtggtatttgggactagtatttcgacttctcctaccgtcaccagcctgcacggactaaagtattttgctaacttnttactagtactaaagtntagactgtcggccctntctacgtttcgcccgtaggaaccaagtaggaaactacgaaacgtacgtggtacgctacgctacgtntcttcg

SEQ ID NO: 42035 - DNA, 514 bp, Homo sapiens
  misc_feature: GYAE6OF02GBCEI.33.63.F08.1.454.CMB.1.raw
  modified_base (273)..(273): a, c, t, g, unknown or other
  misc_feature (273)..(273): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtcttcatctgtaggagacagagtcaccatcacttgccggcaagtgagagcattagaaccttatttgaattggtatcagcagagaccagggaaacncccccaaatcctagactctctgccgcactccgatttacacaagtcggggtacccagtcgtaggttcaggtcggacaggtggatcgtagggacagtatttcactctacacatagactagtctagacctgaagtntttagagtatacttctgtacaanagtacttatacgtaaccgtatacgtttggacgagggacagtcgtaggagtancgaagcgaagtggtacggactgactacctatcg

SEQ ID NO: 42036 - DNA, 548 bp, Homo sapiens
  misc_feature: GYAE6OF02F3J09.33.63.F08.1.454.CMB.1.raw
  modified_base (194)..(194): a, c, t, g, unknown or other
  misc_feature (194)..(194): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagatactagatgtgacgtccagatgacccagtctccatcctccctgtctgcatcagtggganacagagtcaccatcacttgccggcgagtcgggacatttacaatttttgcctggtatcagcagagagaaggggaagttcctagactcctgatctatggtacatcctactttgctaatcaggggtcccatctcgcttcagtggcagtggtatttgggacagtatttcactctcaccgtcaccagcctgcaggctagtaagtattttgactaactttattactcgtactaaaagtatacgacgtagtcggcccgtcttcgtaccgttccggtcccgttagggaacctaaggtaaggaaacgttaccgaaaaccgtaacgttggtaggtacctaggacctaacctagttacttaccgg

SEQ ID NO: 42037 - DNA, 610 bp, Homo sapiens
  misc_feature: GYAE6OF02JJ69M.33.63.F08.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (378)..(378): a, c, t, g, unknown or other
  misc_feature (378)..(378): n is a, c, g, or t
tcagtacacacactcacgaccggtgctcgatttagcgatcgtataaggggcagaagtctctctcagtcaggacacagcatggacatgagggtccctgctcagctcctgggactcctgctgctctggctcccagataccagatgtgacgtccagatgacccagtctccatcctccctgtctgcatcagtgganacagngtcacatcacttgccggngagtcggacatttacaatttttggcctggtatcagtcagagagaagggaagttcctagactcctgatctatggtgcatccattgactaatcgaggggtcccatcctcgcttcgagtggctagtggtatttgggactagtattcgactctctaccgtcaccacncctgcgagtactaaacgtatttacggactaacgttactttacgtcgttaacgtaaaagttacttacgtaaccgtaacggttcgggacccctaccgttacctaacccgttttccgggacccctttacggggaaccctaaacgggttacggtaaaacttaccggtaaaaccgttaaccggttggttaaccgggtccgttacggtacccgtaacccgtagttcccgtttaaccgg

SEQ ID NO: 42038 - DNA, 720 bp, Homo sapiens
  misc_feature: GYAE6OF02FTK3A.33.63.F08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgcatcagtggganacagagtcaccatcacttgccgggngagtcggactatttactaatttttcggctggtatcagcagagagaagggaagttcctagactcctgatctagtggtagcatctacttgactatcgacgggtccatctcgcttacgagtcgactagtgtagtttggactagtacttcactcctactaccgtcaccgacgtcctggactacggtactaggtaaacgtacgtttttacggaacctttaaactttactttaaccgtacgtttaaaccgtaaaaaaggttttcgttaaacgggtaacggttaaccggtacccggggttaacccccgttaccggtttacccgttaacccggtttttacccggggtaccccggttaaccgggggtaaaacccggtttaaaaacggggtaacgggttaaaaaccggttaacccggtaaaaaacccgggtttaaacccgggtttacggggtttaccggttaaccccggttaacgggtaaccccgttaaccccggttaacgttttaccccgg

SEQ ID NO: 42039 - DNA, 581 bp, Homo sapiens
  misc_feature: GYAE6OF02IK6G3.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttactaatttttggcctggtatcagcagagagaagggagttctagactcctgatctatggtgctatcctatttgactaatcgacggggtccctatctcgtcttcagtggactagtggtatttgggactagtactttcgacttcgtaccaccgtccaaccgacgtccgttgccgtacggcttaagaagttattttacgacctttaaactttacttacgtacgtaactaaaagttgtagaacgtagtacggcccgaccttccgtacgtttccgggaccgtacgggaaccgtaaaggtaacggaaactaaccgaaacgtaacgtggtacggtagtaccgactaccgtattccg

SEQ ID NO: 42040 - DNA, 536 bp, Homo sapiens
  misc_feature: GYAE6OF02JLCSC.33.63.F08.1.454.CMB.1.raw
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgcatcagtgggagacagagtcaccatcacttgccgggcgagtcgggacatttacaatttttggcctggtatcagcagagagaaggggaagttcctagactcctgatctatggtgcatcctacttgacaagtcgaggggtcccatctcgtcttcagtggcacgtggtatttgggacagtactttcacttctcaccgtcaccagcctgacaggctagaagtatttnactaacttattactgtaanaaatagtagactgtcgcccgtctcgtactttccggcccgttacggaaccgtaaaggtacggtaaactaaccgaaacgtaacgtaggtacggtactcggactacctacgttacg

SEQ ID NO: 42041 - DNA, 580 bp, Homo sapiens
  misc_feature: GYAE6OF02HIFYI.33.63.F08.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacngagtcaccatcacttgccggcgagtcgggacattacaatttttggcctggtatcagcagagagaagggaagttctagactcctgatctagtgtgcatcctactttgacaatcgacgggtcccatctcgcttcgagtgcagtggtatttggacagtctttcacttctctaccgtcacccgagtcctgaccgtaggctaggtaacggttattttcggacttaacgtttaattaccgttagtaactaaaagtatacgtaacgtaggttacggccccgtactccgttaccgtttcccggcccgttacgggtaaccgtaaacggtacggtaaacgtaccgtaaaaccgtacgttcggtacggaccgttacggcctaccgtattaccgg

SEQ ID NO: 42042 - DNA, 705 bp, Homo sapiens
  misc_feature: GYAE6OF02H5B9L.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtcctccactcctccctgtctgcatcagtgggagacagagtcaccatcactcggccgggcgaggtcggactatttactaagtttttcggccgttggtatcgagcaaggaggaaggtaagggggtaacgttccgtagaccgttccgtagacttctagtggtcgactatcctactttgactaagtcgtacgggtcccagttcgtcgcttcgaggtcggcgtaggtgtaggtttgggactaggttactttaccgacgttcctaccgtaccgtaccgaccgtacggtccgtacggaccgtagggtaccgttaaggaaacgtttattttacgaactttaacgtttacttacgttaacgtaaacgttaaaaggttagtaacggtaaccgtaacgggttacccggtacccgtaccttacccggtttaaccgttcccgggtaccccgggttaacgggtaaacccgtaaaggggttaacgtaaaaccgtaaccggtaaaaaccgttacggttacggtcggtaccgtacgtaccgttaccgtaacgttccgg

SEQ ID NO: 42043 - DNA, 641 bp, Homo sapiens
  misc_feature: GYAE6OF02IB83P.33.63.F08.1.454.CMB.1.raw
  modified_base (528)..(528): a, c, t, g, unknown or other
  misc_feature (528)..(528): n is a, c, g, or t
  modified_base (635)..(635): a, c, t, g, unknown or other
  misc_feature (635)..(635): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtcctccatccctcctgtctgcatcgaggtgggagacagagtccaccataccacgttcggccgggcgagtcggactagtttacttaagtttttggaccttggtactcagcagagaaggaagggtacttcagacctctagacttcgtagtggtgactacttacctacgttttagaacctaagtaccggacggggttaccctacgttccgttacgtcgtttacgaggttcggcgtaggtaggtacgtttgggaacctagttactttacgaccgtccgtaccgtaccgtccaaccgtcgtcctacggcgacggtactagtaagtttctttacgacttaaactttacttaacgttagtaaactaaagttntaacgagttacggccgtacccgtcttacgttaccgttcccggaccgtaacggtaaccgtaaggtacgtaaacctacgtaaacgtagtcggtagccttcgactacgtnttaccg

SEQ ID NO: 42044 - DNA, 708 bp, Homo sapiens
  misc_feature: GYAE6OF02HCGCE.33.63.F08.1.454.CMB.1.raw
  modified_base (419)..(419): a, c, t, g, unknown or other
  misc_feature (419)..(419): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtctccatccctccctgtctgcttctgtcggagacagacgtcaccatcactgccaggcgagtgaggactagttacggtaaatttttaaagttggttacagtacaaggaaaccgaaggggaaaccgtacccctaaggaccttcctagtacttcgacgtaggaccagtacctaagtttacggaaagtaccggggtaccctaacggtaaggttcaaggtggagggtcggagcgtagggactaagttaccttttaccccncgtaaccctataccgaacgtcgaagtccctggaccacgtcccgtaggaacgtcttcgttacgaacctaaacgttaattactttactacgttaaccaaacgtagttaactaattaaacttcccgttaacccgttaacttaccgttttacgggaacccgtaacgggggtaaccctaaaggtaccgttagggaattaaccgtaaccggaaaaccggtaacgttcggtaaccggtaccctaggtaacccctaaccgtaccgtttccggtacggttttaccctagttaaccccg

SEQ ID NO: 42045 - DNA, 515 bp, Homo sapiens
  misc_feature: GYAE6OF02JC9FR.33.63.F08.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgctttcagtggctagtggagtttgggacaggtatttcactctcaccgtcaccagcctgcnggctgaatatttgctaactttntactgtacaaagtntagacagtgcccgtctctacgtttccggccgttagggaaccctaaaggtcgaaactccaaacgtacgtggtcggaccgttgacctaccattccg

SEQ ID NO: 42046 - DNA, 750 bp, Homo sapiens
  misc_feature: GYAE6OF02I9VKR.33.63.F08.1.454.CMB.1.raw
  modified_base (212)..(212): a, c, t, g, unknown or other
  misc_feature (212)..(212): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccgagatgtgacgtcctagatgacccagtctccatcctcctgtctgccatcaggtgggactagagacgtcaaccntcacgttcggccgggcgagtcgggactatttacgtaagtttttcggcctggtactcgagtacgagagtaaggaaggggtaacgttccgtaaggacctaccgtagacgttccgtaagttggtacgtactacgttacccttacttttagaccgtaacgttaccgacgggggttaccccttactccgttcggtacttcgtagtcgggtctaaggttcggtagtttacgggacgtacggtactttacgacttaccgtaccgtacccgttacgaccctacgtacccgtcggtaccgtacgggtctaacgggttaagttagtttaccgaaccttaaatttacccttacggtttaacgtaaaccgttaaacgtttaacgttcgggaactaacgggttaccgtaccccgtacgttaccgttacccgttacccggtccgttaaaccggggtaccgtaaaacggtttaacgtaaacttaacccggaaaccgttaaccgggtcgtttacggtaccgtccggtaacccgtaaacccgttcgttaacccgg

SEQ ID NO: 42047 - DNA, 622 bp, Homo sapiens
  misc_feature: GYAE6OF02G770D.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggactatttactaatttttggccttggtatcagcagagaggaagggaagttcctagactcctgatctatggtgctactcctactttgacaatcgacggggtcccagtctcgtcttcgagtggctaggtgtagtttgggactagtatttcacttcctccgaccgtcaaccgacgcctgcgacggctaggtaacgttattttagaccttaaactttatttacgttacgttaacgaaaagttacgtagtaactacggtccggtaccccgtcgttaccgttacccgtttccgggtacccgttacggggtaacccgttaaacgggttacggtaaaaccgttaccgaaaaccgggttaacctacgggttacgggaccgttacggacccgtaaccgtattaccg

SEQ ID NO: 42048 - DNA, 584 bp, Homo sapiens
  misc_feature: GYAE6OF02IPHWY.33.63.F08.1.454.CMB.1.raw
  modified_base (193)..(193): a, c, t, g, unknown or other
  misc_feature (193)..(193): n is a, c, g, or t
  modified_base (378)..(378): a, c, t, g, unknown or other
  misc_feature (378)..(378): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctcctgtctgcatcagtggganacagagtcaccatcacttgccgggcgagtcgggactatttactaatttttggcctggtatcagcagagaggaagggtaacgttctagacctcgtgatctatggtgcatcctactttgacatcgacggggtccagtcttcgcttcagtggacgtagtgtagttggactagtattcactctacaccncaccagtcctgacgacgtcgtagtaagtattttgaccttaactttacttacgttagttaaactaaaggttatagaccgtaggttaccggacctccgttacctaccgtttccgggccccgttaagggtaacccgtaaaggttaacggtaaaactacccgaaacggtaacgttcggtacggaccgttacggactacccgtatttaccg

SEQ ID NO: 42049 - DNA, 728 bp, Homo sapiens
  misc_feature: GYAE6OF02IFQY2.33.63.F08.1.454.CMB.1.raw
tcagtacacacactcacgaccggtgctcgatttagcgatcgtataagggggcagaagtctctctcagtcaggacacagcatggacatgagggtccccgctcagctcctggggctcctgctcctctggctccgaggtgccagatgtgacgtccagatgacccagtcctccatcctccctgtcttcatctggtaggagacagagtcacatcacgttcggccgggacaagtgagacgactattaacgaaccttagtttagtaattggtactacgagacgaagacgaccgaaaggggaaaccacccccaaactcctagtacttctaccgtacgccgacacgttaccgtaatttaccaacgtaacgtcgggtacctagtcggtaggttcgagtcggactaggtggactcgagggactagtacgttaccacttccgtaacctaacctaagtaacgcgtaacgttccggtaacggtaaaccgtaggtaaaggttttagtttaacgggaaattaccttactttgttaacgtaaccgaaaccgtaacgttaacggttttaaaccaaccggttaaacccttaccgtttacgtttaaccgggaaccccgtaagggtaaacctacggtacggttcgggaaagttacgtaacccggtaaaggttacccggtaaacggttacgggttccgggtaacgttccgaaccccgtaaccgtttaccgtttaccggtccgtttaaccc

SEQ ID NO: 42050 - DNA, 636 bp, Homo sapiens
  misc_feature: GYAE6OF02GHZ11.33.63.F08.1.454.CMB.1.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatccctcctgtctgcatcaggtgganacagactcaccatcacgttcggccgggcgacggtcggactatttactagtttttggctgtatcagcagagaggaggtagtcctagctcngtatntagtggtgcactcctatttcgactacgtcgtacgggtccatccgtcgtcttacgaggtcggtacgtaggtcgggttagttcgggactaggttacgtttcctacttccgtactacccgtcaacccgtgtccgtacgtcgtaacggtaacttaaacgttcgtttacgtacttaaaccgtttattacgttaagtaacgttaaaagttgtaacgtacgtacggttccggacccgtcgttaccgttaccgtttacccggacccggttacggtaaaccgtaaaggttacgtaaaacgtacctaaaacggactttagggtacgtaccgtcgtacctacccgtagttccgttaccg

SEQ ID NO: 42051 - DNA, 667 bp, Homo sapiens
  misc_feature: GYAE6OF02F95FO.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggctccagataccagatgtgacgtccagatgacccagtctccatcctccctgtctgcatcaggtgggagacagacgtacaccatcacgttggccgggcgaggtcgggactatttactaatttttcggcttggtatcagcgagagaaggaagggtattctagactctgactcgtatggtgcattcctatttgactaagtacggacggggtccctagtcgtacgtcttacgagtggctaggtggtacgtttgggacgtagtatttactacctacgtctaccggtccaaccgtacgtccctaggaccgagggtaccgtaaggtaaacttgttttacgaccttaaacgtttactttaaccgttagttaaaccgtaaaagttacgtacgaacgtccgggttaccggaccccgttagtacccttaccggtttacccgggacccgttaggggtaaaccccgtaaagggttaacggaaaacgttaaacccgtaaaacggttacggttcggttaacgggacctttacggacccttaaccgtacgttaccgg

SEQ ID NO: 42052 - DNA, 650 bp, Homo sapiens
  misc_feature: GYAE6OF02HS1X3.33.63.F08.1.454.CMB.1.raw
  modified_base (221)..(221): a, c, t, g, unknown or other
  misc_feature (221)..(221): n is a, c, g, or t
  modified_base (302)..(302): a, c, t, g, unknown or other
  misc_feature (302)..(302): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctcatccctcctgtctgcatcaggtgggagacagacgtcaccatcacttggccgggngaggtcgggactagtttacttaagtttttggctggtatcagcagagaggaagggtattccagactctagatctagtcggtnctacgtcctatttcgactaagtccggtacgggtacccattcctcgtacttcgaaggtcgacgtagttggtaagtttcggggacaagttactttcgacttcgtaccgtacccgtcaacccgtacgtcctacggcgtaaggtaccgttaaggtaacgtttacgtttacggaacctttaaacgttaatttaaccgttaagtaaacgttaaaaagttgtaaccgtaacgtacggtcccggaccgttcttaccgttaaccggttccggacccgtaagggtaacctaaagggttaaccgtaaactaaccggtaaacgtacgtcggtaacgtccgaacggtactaccgtctacgg

SEQ ID NO: 42053 - DNA, 568 bp, Homo sapiens
  misc_feature: GYAE6OF02GA6XL.33.63.F08.1.454.CMB.1.raw
  modified_base (392)..(392): a, c, t, g, unknown or other
  misc_feature (392)..(392): n is a, c, g, or t
  modified_base (445)..(445): a, c, t, g, unknown or other
  misc_feature (445)..(445): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtccaccatcacttgccgggcgagtcgggacatttacaatttttggcctggtatcagcagagagaaggggaagttcctagactcctgatctatggtgcatccatttgacaatcgacggggtcccattctcgcttcagtgcagtggatttgggacagtatttcactctcacgtcacacgctgcagctagaagtnttttgactaacttattactagtactaaaagtactagacgtacgtcggcccgtntaccgttacgtttcccgggacccgttagggtaacccgtaaaagggttacggtaaaacttacccgaaaacggttaacccgtagggttaccggaccgttacggaaccctaccgtactttacccgg

SEQ ID NO: 42054 - DNA, 601 bp, Homo sapiens
  misc_feature: GYAE6OF02H9YZ9.33.63.F08.1.454.CMB.1.raw
  modified_base (197)..(197): a, c, t, g, unknown or other
  misc_feature (197)..(197): n is a, c, g, or t
  modified_base (325)..(325): a, c, t, g, unknown or other
  misc_feature (325)..(325): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgaccccagtcctccactcctcctgtctgcatcaggtggganacagagtccaccatcacttcggcccgggcgaggtcggactattttaacttaagttttttggccgttggtatcgagtcagagaaggaaggggtacgttccgtagacctaccgtgtattagttagtggtnactacttcctactttgacgtaactcgacggggtcccatcttcgacttcaggtcgacgtagtagtagtttgggactagttactttcactctaccaccgtcacctacgcctcggcctaggtctaagtagttacgttacgtacttaaactttacttaacgttagtaacgtaaatagtacgacgtacgttccgaccgtctacgttccgttaccgccgtacggtaaccgtaaggtacgtaacaacgtaaacgtaacgtggtctacgactccacgtataccg

SEQ ID NO: 42055 - DNA, 587 bp, Homo sapiens
  misc_feature: GYAE6OF02FWLD9.33.63.F08.1.454.CMB.1.raw
  modified_base (195)..(195): a, c, t, g, unknown or other
  misc_feature (195)..(195): n is a, c, g, or t
  modified_base (481)..(481): a, c, t, g, unknown or other
  misc_feature (481)..(481): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcgagtggganacagagtcaccatcacttggccgggcgaggtccgggactatttactaatttttggccttggtatcagcaaggagaaggaaggggtaacttcctagacctcctgatctagtggtgctatcctatttgactaatcgacgggtcctatcctcgtcttacaggtggactaggtgtagtttagggactaggtactttcacttcgtaccgtaccgtccaccgacgtcctgaccgtacggccttaggaacgttacttttagaccttaacgttattacgtagttaacaaagttntacgagtacgtcgccgtctacgtaccgtttccgaccgtaggaacccgtaaaggtacgtaaactaccgtaaacgtacgtgtacggtacctagacctacgtattaccg

SEQ ID NO: 42056 - DNA, 828 bp, Homo sapiens
  misc_feature: GYAE6OF02G258G.33.63.F08.1.454.CMB.1.raw
  modified_base (197)..(197): a, c, t, g, unknown or other
  misc_feature (197)..(197): n is a, c, g, or t
  modified_base (567)..(567): a, c, t, g, unknown or other
  misc_feature (567)..(567): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtctccatccctcctgtctgcatcgaggtggganacgagtacgtaccaaccatacctacgttcgggcccgggacggtacgggtaccgggtactaacttttaacgtttaacgtttttttcgggaccttagggttacttacgacgtacgaaggaagggaagggtaacggggtaacgtttccgtaacggtaccttccgtagtattccgttaggtcgggttacgactacgttacccttagtttcggaaccgtaacgttaccgggaccggggttaccctacgttaccgttccggttaccttacggtacgggttcggaccggttagggttacgggtttaaggttttacgggaacgttacggtttaacgttttacccgaccgtttacctacccgaacctacgtaccgtacncgttacggttacgttaccggaaaccgtacgttaacggttaaagtttacgttttaacggaacctttaaacgtttaccttacggttaacgtaacctaacggtacgtaacctaccgtaaacccgtaaccttaccccttagttaacccgttcccggtttacccggtacccgggtacggttaaccctacgggttaaggtaccggtaacgttaccgggtaaccgttaaccggttaccggttaggtccggtaccgtacccgtaaccgg

SEQ ID NO: 42057 - DNA, 542 bp, Homo sapiens
  misc_feature: GYAE6OF02HCLYA.33.63.F08.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (393)..(393): a, c, t, g, unknown or other
  misc_feature (393)..(393): n is a, c, g, or t
  modified_base (441)..(441): a, c, t, g, unknown or other
  misc_feature (441)..(441): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagactaccagatgtgacgtccagatcgacccagtctccatccctccctgtctgcatcgagtgggagacagngtccacatcacttggccgggcgaggtcggactatttactaagtttttcggaccttggtatcagcagagaggaagggtactcgtagactctgactctatggtnctaactccgtattgacaagtccgacgggtccatctcgtctcgtaggtgactagtgtacgttggactagtacttcactctcacgtcacncgctgcagtctagtagttattgactaattactactgtaaactaaagtntagactagtccgacctactccgtcttccgccgttaaggaacctaaaggtaaccgaagttaacccgaacgtacgtacggtgtcctaggacctacgacttacg

SEQ ID NO: 42058 - DNA, 624 bp, Homo sapiens
  misc_feature: GYAE6OF02I8325.33.63.F08.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (317)..(317): a, c, t, g, unknown or other
  misc_feature (317)..(317): n is a, c, g, or t
  modified_base (483)..(483): a, c, t, g, unknown or other
  misc_feature (483)..(483): n is a, c, g, or t
tcagtacacacactcacgaccggtgctcgatttagcgatcgtataagggggcgagaagtctctctcagtcaggacacagcatggacatgagggtccctgctcagctcctgggactcctgctgctctggctcccagataccagatgtgacgtccagatcgacccagtcctccatccctccctgtctgcatcgagtggganacagacgtacaccatcacgttcggcccgggngacggtcggactacgttacttaagttttcgccgttgtatcagtcagagaggtaagggagttccaggtactcctagactgtagtggtntctacgtcctacttgtactaagtccgacgggtccctagtccgtcgtcttacgagtcggataggtgtagttcggacgtagtcgtttacgacttcctaccgtaccgtccaacccgtacgtccgtgccgtacgtcgtaagtacgtttactttacgtaacctaacgtttnttaccgtagtaactaaaggtatacgtgtaacggtcgtacccgtcgtacgttccgttccggacccgtaggtaacccgtaaggttaactaaacggtacctaaacggttacgtcggtcgtaccgtcgaacctccgtattcccgg

SEQ ID NO: 42059 - DNA, 602 bp, Homo sapiens
  misc_feature: GYAE6OF02GDTJM.33.63.F08.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (514)..(514): a, c, t, g, unknown or other
  misc_feature (514)..(514): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatcgacccagtctccatccctcctgtctgcatcaggtggganacagntcaccatcacttggccggngaggtcggactatttactagttttgctggtatcgagcagagaggagggaatctagactcagtatcgtagtgtgctactcctagttcgactaacgtcgacgggtcccagtccgtacgtccttacgtaggtcggtacgtaggttacggtagtttacgggactaacgttactttacccgtacttccgtaccgacccggtacccaccgtacgtcccgtagcgtacggtcgtaagtacgttacgtttacgacttaacttacgttacgtataacgtaaagtcgtagacgtcgcgtcccgnttccgtaccgttccggaccgtcggaacgtaacgtaacggtaactaaaccgaacgagttacggcggtacctcgaccgtaccgtattccg

SEQ ID NO: 42060 - DNA, 703 bp, Homo sapiens
  misc_feature: GYAE6OF02JYFU8.33.63.F08.1.454.CMB.1.raw
  modified_base (169)..(169): a, c, t, g, unknown or other
  misc_feature (169)..(169): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (694)..(694): a, c, t, g, unknown or other
  misc_feature (694)..(694): n is a, c, g, or t
tcagtacacacactcacgaccggtgctcgatttagcgatcgtataagggggcgagaagtctctctcagtcaggacacagcatggacatggagggtccctgctcagctcctgggactcctgctgctcgtggcctcccagatacccagtatgtgacgtccagatcgaaccngttcctccacttccctccctgtcctgctatcgagtggganacgngacgtccacctatcacgtggccgggcgtagtcggacttagttactagttttcggctgtatcgagacgaggtagaaggaaggggtacgttaccgtaacgtacctccgtanacgttacttagtcgggtntaccgtaacttcccgtagttttacgacgtagtaccggtaccgggtcccgtaacgttccgtccgtacgtttacgaggttacgtaggtaggtggtaagttggggaacgttacgtactttccgtacctccgtacgtaccccgttccacccgtcggtacctcggacgtcggtagttacgtaagtttacgttagaccgttaaactttattaccttaagttaacgaaacgtttaggtacgacgttacggtcccggtcctaccgttaccgttacccgtacgggtaccctagggtaacccggtaaagttaacggtaacctaaacgtaacggttaacgtcggttacaggttccgacccgttancgtttaccg

SEQ ID NO: 42061 - DNA, 674 bp, Homo sapiens
  misc_feature: GYAE6OF02GEEFB.33.63.F08.1.454.CMB.1.raw
  modified_base (295)..(295): a, c, t, g, unknown or other
  misc_feature (295)..(295): n is a, c, g, or t
tcagtacacacactcacgaccggtgctcgatttagcgatcgtataagggggcagaagtctctctcagtcaggacacagcatggacatggagggtccctgctcagctccgtgggactcctgctgctcgtcggctcccagactaccagatgtgaccgtcagatcgaccctagtctaccactccctccctgtctcgcctatcgaggtgggagacgagacgtaccaacctatccacgttcggcccgggtgacggtcgggaactagttttaacttagtttttcggcgttggtactcgagngaaggaggtaagggtaaggggtaccgttaccgtagtacctccgtagtacttacgtagtaggtcgctagtccttacttacgataacgtcggaccggtcctagtctcgtctacgtggtgacgtggtaggttagttacggaatacgttcttctaccgttcctccgacccgtaaccaccgacgtccgtaggccgtaggtcgttaacgtaacgtttctttacgaacctttaactttacgtacttaacgtaaactaagttagaacggttcgacggtcccgtacctaccgtaccgttacccgttaccgggacctaacgggaacgtaaacggtaacgtaaactacccgaaacggtactacggtgtacccgtacaccgtactacgttc

SEQ ID NO: 42062 - DNA, 867 bp, Homo sapiens
  misc_feature: GYAE6OF02I20K7.33.63.F08.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
tcagtacacacactcacgaccggtgctcgatttagcgatcgtataagggggcagaagtctctctcagtcaggacacagcatggacatgagggtccctgctcagctcctggactcctgctgctctcggctcccagactaccgagatgtgaccgtccagatcgacccagtctccatcctcccgtgtctgcnttacgagtggganacgagacgtacaccactacctacgttacggcccggggacgtacggtaccggggtaactagttttaacgttaagttttttcggaccttcggttactaccgtagaccgaggagaacgggtaaacggggtaacgtttaccgtaagtaccttccgttacgtaacttaccgtagtacgggttagaccgtaccttacccgtacgttttacggaccttaacgttacgggaaccggggttacccaacgtttccggttaccggttacctttacggtaacgggttcggtacgttaaccgggtagggtttaacgttttacggggaaaccttacgggttttaaaccgttttcctaaacccggtttcccttaccgtaaaccccggttaccaaacccgttacccggttaccgttacgggaacccgttagggtacccgtttaaggggtaaacctttaaaggtttcccggtaaattaaaccctttttaacgggtttaacctaggttaaacccgttaaaaggttagtaccggtaacgtagggttcccggaaccgttacgttaccgttaacgttcccgggtacccgtttaacggaaaccggttaaaacgggtttaacgaaacggttaacctaaaaccggtacgtttacgtaacgggtcggttacctacgtaccgttactccgg

SEQ ID NO: 42063 - DNA, 554 bp, Homo sapiens
  misc_feature: GYAE6OF02HSFIW.33.63.F08.1.454.CMB.1.raw
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (494)..(494): a, c, t, g, unknown or other
  misc_feature (494)..(494): n is a, c, g, or t
  modified_base (546)..(546): a, c, t, g, unknown or other
  misc_feature (546)..(546): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtcgacgtccagatgacccagtctccatcctccctgtccttacatctgtaggagacagagtcaccatctcttgccggcaagtcagagcatacgtccgctatttaaatggtatcaganaccccccccgaaanaggcaacgaccctaaactcctanactctatgctgcgtcagtctgactaaggtcggtacccagtacgaaggttacgagtcggacgtacgtcgggtcgttacggggactacggtaccttactacctcgtaccacgatacgagtacagtaccgtagagaccagtaagttctttagactagttactttactgtacgtgcagtcgtgtactaactcgacctaacnccgttacgaccgtaagaccacgactaggaactagtaaacctagtcggtacgngtacgacg

SEQ ID NO: 42064 - DNA, 694 bp, Homo sapiens
  misc_feature: GYAE6OF02GC9YS.33.63.F08.1.454.CMB.1.raw
  modified_base (295)..(295): a, c, t, g, unknown or other
  misc_feature (295)..(295): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttggccggcgagtcggactattactagtttttgctgtatcagcagagaggaagggtaacttctagactcctagattctagtggtncgtactcctatttcgctaagtccgtacggggtacccagttctaccgtcttacgacggtcggctaggttcggtagtttcgggactagtagtttcactcgtcaccgtcaccgtacgccgtacgaccgtaggtccgtaggttaaacgttcgtttttaacggacctttaaacttttaacgtttaaccgttaacgttaaacgttaaaaaggttcgtaacgttaaccgttacgggttaacccgggtccccggtaccgttacccgtttaaccggttttccccgggaccccgtttaaccggggtaaacccggtaaagggttaaaccgggttaaaccgttaaacccgtaaaaccggttaacggtacgggttaacgtccggttaaccgtaccctaccggtcttacccgg

SEQ ID NO: 42065 - DNA, 731 bp, Homo sapiens
  misc_feature: GYAE6OF02G3DRK.33.63.F08.1.454.CMB.1.raw
  modified_base (199)..(199): a, c, t, g, unknown or other
  misc_feature (199)..(199): n is a, c, g, or t
  modified_base (356)..(356): a, c, t, g, unknown or other
  misc_feature (356)..(356): n is a, c, g, or t
tcagtacacacactcacgaccggtgctcgatttagcgatcgtataagggggcagaagtctctctcagtcaggacacagcatggacatgagggtccctgctcagctcctgggactcctgctgctcgtggctcccagactaccagatgtgacgtcagatcgacccagtcctccatccctcctgtctgcatcgaggtggganacgacgtacgtccacctatctacgttcggccgggtcggtaacgggtcgggaacttattttaacgttaagtttttttcggccgttggttactacagtacaggtaggaaagggtaacggggtaacttaccgtagaccgttcctgtaactctaggttggngactactccttaagttcactaacgttccggaaccgggtccctatccgtcgtcttacgaggtcggacgtaggtgggtagtttacggggactagttacttcacttacctccgtaccgtccgaacccgcgtccgtcgaggtaccgtacgtacggtaattttcgttaacgtacttaaacgtttactttacgaacgttaaactaaaaaggttgtaacgtaacggtacggaccgtaccccggttaccttaccgtacccgggttttacccgggacccgtttaaaccgggtaaacggtaaacggtaacggtaaaacgtaacccggtaaaaccgttaggttacccggtaggttacccgaaccggttccaaccggtacttaccgg

SEQ ID NO: 42066 - DNA, 781 bp, Homo sapiens
  misc_feature: GYAE6OF02IPHKR.33.63.F08.1.454.CMB.1.raw
  modified_base (203)..(203): a, c, t, g, unknown or other
  misc_feature (203)..(203): n is a, c, g, or t
tcagtacacacactcacgaccggtgctcgatttagcgatcgtataagggggcagaagtctctctcagtcaggacacagcatggacatgagggtccctgctcagctcctgggactcctgctgctctaggctcccagataccagactaggtgacgtcccagtactgacccagtcctccactccctcctgtctgcatcgagtgganacgagactaccaccatcacttcggccgggacgaggtcgggaactattaacttaagtttttcggcttggtactcagacaggaggaaggtaaggggtaacttaccgtaggtacctccgtagacttcgtaaggtggtcgacgtacttacccttagtttcgactaacgtcggacggtcctagttccgtccgtccttagacggtcggtaacgtaggttcggtaggtttacgggacgtaacgtttacgtttacctaacgttcccgtaccgtaaccgtccaaacccgttcggtacccgtacggacgtaaacggtacctttaaaaggttaccgttttaaccggaacctttaaaccgttttacgtttaaccggtaccgtttaaaacgtaaaaccgtttaggtaaccgtaacggttaccggtaaccgggttccccctaacttttcccggtaacccgtttacccggggtacccggttaacggtaaaccggttaaaaaggtcccggttaaaaacaacccgggttaaaactacgggttacgttaaccggcccgtttaaccgaacccgttaaccctacgtttaccgttaccc

SEQ ID NO: 42067 - DNA, 615 bp, Homo sapiens
  misc_feature: GYAE6OF02IGWR5.33.63.F08.1.454.CMB.1.raw
  modified_base (267)..(267): a, c, t, g, unknown or other
  misc_feature (267)..(267): n is a, c, g, or t
tcagtacacacactcacgaccggtgctcgatttagcgatcgtataaggggcagaagtctatctcagtcaggacacgagcagtggacatggagggtcctgctcagcctccgtgggactcctcgctgtctcgtcggctcccgagactaccgagtagtgtggaccgtaccgagtactcggtaacccacggttcctccctacccctccgtcgtctgctatcgttggtcggagacaggacgtcaccattctcgttggccggacagctagacncatcgtccgtactaatttaaacgtggtatacagtcaagaaccgaggaccaacggacccctaaactcgtacgattacgtactagtccgtcgtcggtactacgtctagtaccgtaaggtcgggtacccagttacgtagttacgagtggactggtagtcgtcgtaggactagtacttcgactctacaccagtacagtactacgtcgtcacgtaaccgtagtaacgttattgtacctaagttctacgtctacgtaacgtactacgttacaacgttcccaaccgttctaacgttgacgtacgggaactacgtagtacgtgaacgtcgaacgtccgtaagtcgtacgtacgtcg

SEQ ID NO: 42068 - DNA, 809 bp, Homo sapiens
  misc_feature: GYAE6OF02JAROT.33.63.F08.1.454.CMB.1.raw
  modified_base (197)..(197): a, c, t, g, unknown or other
  misc_feature (197)..(197): n is a, c, g, or t
  modified_base (787)..(787): a, c, t, g, unknown or other
  misc_feature (787)..(787): n is a, c, g, or t
tcagtacacacactcacgaccggtgctcgatttagcgatcgtataagggggcagaagtctctctcagtcaggacacagcatggacatgagggtccctgctcagctccgtgggactcctgctgctctgctcccagactaccagatgtgacgtccaagatcgacccagttcctccacttccctccgttgtcttgcctancgtaggtgggaacgacgacgacgtccaacctacttccgaccgttcggccggggacgtagggtaccgggacttaagttttaacttaacggtttttcggaccgttaggtacttctaaggcgaaggacggaagggtaaaggggtaacgtttaccggtaacgtaccgtaccttacgtaacgttaccgttaggttcggtacgtaccgttaaacttcccttaacgttttacgaacccttaaggtaccggtacgggtttacccacgttccttccggtcgtttaccgacgggtttggaccgttagggttaccggttaacggttttacgggaacgtttacggttaaccttttccgtaacccgtttaccgttaccccgttaacccgtccccgtaacccgtaacccggttccgtaacggtcccggaaggtttacccggttaagttaacgggtttttattaccggtaaaccttttaaaccgtttacgtttaaaccgttaagttaaaccgtaagttacgtacgtaccggtagttcgccctttagacttcccggttccgaccgtacggtaacgtaacggtataaacgtacgaaacgttgtacgnggtacctgacctactcgttacg

SEQ ID NO: 42069 - DNA, 833 bp, Homo sapiens
  misc_feature: GYAE6OF02HS9NE.33.63.F08.1.454.CMB.1.raw
tcagtacacacactcacgaccggtgctcgatttagcgatcgtataaggggcagaagtctctctcagtcaggacacagcatggacatgagggtccctgctcagctcctgggactcctgctgcctctggcctcccgagtactaccagtatggtcggaccgtaccagtatcgaccctagtcctcacttccctcctgtctgctaagtcgagggtgggatacgaggtatacccacctaactccgtacggttcggcccggggacgtaggtaccgggtaacttaacttttaatttaacgtttttttcggccgttaggttatccacgtacaaggagtaaggggtaaacgggggtaactttccgtaacgtaccgttaccgtaggtacttacgtagttagggtacctgtaaccttcccttaagttccgaacctaggttacccggtaccggggtacccctagttcgtaccggttcttacgtggttcggacgttaggttacggttaaggtttacgggaactttacggttacttttacccgcgttaccccgtacctaacccggttacccaacccgtacgtacccgtacgccgtaccggtaggttaaggtaacgttttacggttttaactaacctttaaaccgttgttttaaaccggtaattaaaacgttaaacgttaagtacgtaacggttacggtacccgtacccgttagtttaccccgttaacgggttcccggttacccggtaaacgggttaaaccgaagggtttaaaaccaaaccgttaaacccggaaaccgttaggttaaccggtaccggaccggtaccggaaaccctcgttacgtttaccg

SEQ ID NO: 42070 - DNA, 648 bp, Homo sapiens
  misc_feature: GYAE6OF02GDLS1.33.63.F08.1.454.CMB.1.raw
  modified_base (194)..(194): a, c, t, g, unknown or other
  misc_feature (194)..(194): n is a, c, g, or t
  modified_base (445)..(445): a, c, t, g, unknown or other
  misc_feature (445)..(445): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcaggtgganacagagtccaaccatccgacgttcggccgggcgaggtaccgggactaagttttaactaagttttttcggccttggtatcagctagagaggaaggggtagttaccgaagtactccgtgattctagtcggtgactacgttccctactttacgacctaattaccggacggggtccctagtcctcgtccttcgaggtcgcgaggttggtagtttgggactaggtactttacgaccttactcctaccgtctaaccncgtacctcgactacggtcctagtaacgttagtttcgaaccttaacgtttaattacgtacgttaacgtaaagttataacgacgtaacggtcgtacccgtacttccgtaccgttccggtaccgtacgggtaacctaaagggtacgtaaacgtaaccgtaaaccgtagttaccggaggtcccgtacgtacctaccgtattacccgg

SEQ ID NO: 42071 - DNA, 777 bp, Homo sapiens
  misc_feature: GYAE6OF02F184W.33.63.F08.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (340)..(340): a, c, t, g, unknown or other
  misc_feature (340)..(340): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagngtcacctatctacgttcggccgggcgaggtccgggactatttaacgtaatttttcggccttggttatccgagtacgaaggacggaagggtaaaggggtaactttaccgtagaccttccgtggtaacttcttagttggtacnctacttacccgttactttggaacctaagttaccggaacggggttacctaccgttcttaccggtccttacgtaggtacggtggtaacggttggggttacggtttagggtacggtaagttacgtttactaccgttaccgtaccgttaaccccgtaccgtaccgtaacgtccgtcgtacggtaccggtacgtaacggttaacgtttaacgttttacgttaaccggttaaacctttacgttttaaacgttacggttaaaacgttaaaccgttaagtacgtaacgtacgggttaaccggttacccgtcccgttaacgttacccgtttacccgggtacccgtaaccgggtacggtaaaaccggttaacggtaaaccgttaaccgtaaaccgtaccggtttacggttacggtaccgtacccgtaacgtacccgttagttacccg

SEQ ID NO: 42072 - DNA, 756 bp, Homo sapiens
  misc_feature: GYAE6OF02GXYK8.33.63.F08.1.454.CMB.1.raw
  modified_base (209)..(209): a, c, t, g, unknown or other
  misc_feature (209)..(209): n is a, c, g, or t
  modified_base (749)..(749): a, c, t, g, unknown or other
  misc_feature (749)..(749): n is a, c, g, or t
tcagtacacacactcacgaccggtgctcgatttagcgatcgtataagggggcagaagtctctctcagtcaggacacagcatggacatgagggtccctgctcagctcctgggactcctgctgctcgtggcctcccgagactaccgagactgtgaccgtccagatcgacccagtcctccatccctccctgtcctagctatcgaggtggganacgaggtactccaacctataccgtacgttcgggcccggggacgtaacgggtccggtaaccttagttttaaccgtttagtttttcggccgttaggttactcgacgcgaggaggaaggaacgggtacgttaccgtaagtacctacgtagtactcgtaggtgtacgcgtacttaccgtacgtttacgaacttagtccggtaccgggtacctacgttacccgtcgtccgttaaccgtcggtacggtaccgtaggttaccggttaggttacggtacgtaacggtttaccttacccttacccggtccgtaacccggtaccccgtaccgtacccgacggttaccgtcggtaacgcggtaaaccgtgggttaacttacgtttaccgaagtttaaccttaagtttaccgtaaacgtaacgttaaagtacgttaccgaacgggttaccgcccgttaacgtcttacccgtaccgtcccggtacgtaacggaagtaacggtaccgaacgtaaaccgacggttacgacggttcgagtaccccgattaccggtnttaccgg

SEQ ID NO: 42073 - DNA, 679 bp, Homo sapiens
  misc_feature: GYAE6OF02IR3B7.33.63.F08.1.454.CMB.1.raw
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (286)..(286): a, c, t, g, unknown or other
  misc_feature (286)..(286): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
tcagtacacacactcacgaccggtgctcgatttagcgatcgtataagggggcagaagtctctctcagtcaggacacagcatggacatgagggtccctgctcagctccgtgggactcctgctgctctggctcccagataccagatgtgacgtccagatcgacccagtctccatccctcctgtctgcatcgaggtgggananaggntcaccatcgacttgccaggcgaggtcgagactattacggttaaatttttaagtggtttacagtacagtaaacgagggaaccncccgtagaccttaccgagtacttaccggacgtacgactacgtacctaagttacgggaaagttacggggtaaccctaggtaacggtgaggtacgggaggtggggacnggtagggactaggtacctttacccgctacacgtcacncgtaactccgtagaccgtacgccgttaagagttactcgttacggaactaactattttaagtccttacgtaactaaactagttaaagttaaaccttacggtaccctacggttaacttaccgtttcgggacccggtaaggaacccgtacggtacgtacgggtaactaaccgggtaaaccctaacggttaaccggtcgttaacgggcctaaccggttaccacgttttaccggacctttttcgacgttttaccc

SEQ ID NO: 42074 - DNA, 623 bp, Homo sapiens
  misc_feature: GYAE6OF02HCMRH.33.63.F08.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (615)..(623): a, c, t, g, unknown or other
  misc_feature (615)..(623): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctcccagataccagatgtgacgtccagatgacccagtctccatcctccctgtctgcatcagtggganacagngtacaccatcacttgccggnagtcgggactatttacaatttttggccttggtatcagcagagtaggaagggagttactagactcctagtatcgtatacggttgaccaattccctacgttttaggacaacttcgaacgggggttccctattaccgtcgttccttacgtaacggttcggcgtaggtggttagtttaggggaactaggtatttcgaacttctctaccgtcctacctagccgtacgtcgagcgtagaacgtagttttactacgtaacttaagttaccttaacgtaacgttaaaacgtaacgttacgacgtaacggtacggtcccgtacgttaccgttaaccgtttaccgtccccggtaaccgggtaacccgtaaaaggttaaccggtaaacgttaaaccgaaaaccgttnnnnnnnnn

SEQ ID NO: 42075 - DNA, 750 bp, Homo sapiens
  misc_feature: GYAE6OF02JCLI7.33.63.F08.1.454.CMB.1.raw
  modified_base (186)..(186): a, c, t, g, unknown or other
  misc_feature (186)..(186): n is a, c, g, or t
  modified_base (410)..(410): a, c, t, g, unknown or other
  misc_feature (410)..(410): n is a, c, g, or t
tcagtacacacactcacgaccggtgctcgatttagcgatcgtataagggggcagaagtctctctcagtcaggacacagcatggacatgacgggtccctgctcagcctcctgggactcctgctgctctggctccagataccagatgtgaccgtccagatcgacccagtcctccattccctcctcgtntgctatcgagggtgggagtacgaggacgtaccaacctactaccaccgttcgggacccggggacggtaacgggttaccgggacttaacgttttaccgtttaacgttttttacggcccgttaggttactaccgacgtaccggtaaggaaggaacggggtaaggggttaacttaccgttacgtactaccgtagtacttcgtagttcgtagactacctcttacgtttnacgtatcggtaccggtactactcgtacgtctcgtaggtcggacgtggtacggttagtacggaactagttacttctaacgtctcccggaaccgttacaaccgacttcggacacggtacggtcgtaacgtaacggtttacttaagtaaccgttaaacttttcgtaaccggtaagttaacgttaaagtaccggttacggaacgaacgggttccgaccgtttaaccttaccgttcccggttacggtccccgggttaaacgaccggttaaacggtaacggtaaaccgtaacgtaaaccggtacgtacggttacctccgggtaacgtactacccgtttgttaaccg

SEQ ID NO: 42076 - DNA, 714 bp, Homo sapiens
  misc_feature: GYAE6OF02IPDK5.33.63.F08.1.454.CMB.1.raw
tcagtacacacactcacgaccggtgctcgatttagcgatcgtataagggggcagaagtctctctcagtcaggacacagcatggacatgagggtccctgctcagctcctgggactcctgctgctctggcctcccagataccagatgtgacgtccagatcgacccagtctcctatccctcctgtctgcatcgaggtcgggagacagagtccaccatccgtaacgttcggccggggacgtaggtccgggaaccttagttttaaccttaagttttttcggccttaggggttactacgaggctaaggaaggaaggggtaaacgggggtaacgtttacccgtaggtacccttacgtaggtaactcgttaagtcgggtcgtactaccgtaccgttacgttttagtacctaacgttccggaacggggttaccctaagtccgttctaccgttcgtagtggacgtggtagtaggtttacgggactaagttcgttcacgttctacctaaccgtaccacccgtaggccgttagacgtagacgtagtaagttcgtttacgacttaacgtttactaacgttgtaaacgtaaagttcgagtacggtacgtcgacccttacgtccgttagttcccgggacccgttaggtaaaccggtaagtaccggtaaaacgtccgaaaacgttaccggtggtaacggtccgtaacgtcccgtaaccgtggtttacccg

SEQ ID NO: 42077 - DNA, 728 bp, Homo sapiens
  misc_feature: GYAE6OF02IGXD2.33.63.F08.1.454.CMB.1.raw
  modified_base (715)..(715): a, c, t, g, unknown or other
  misc_feature (715)..(715): n is a, c, g, or t
tcagtacacacactcacgaccggtgctcgatttagcgatcgtataagggggcagaagtctctctcagtcaggacacagcatggacatgagggtccctgctcgagcctccgtgggactcctgctgctcgtcggcctcccagactaccgagattggtgaccgtccagactcgacccagttctaccactccctcccgttgtctcgacacgtcgaggtagggacgacagacgtaccacgtatcgttacgtcggccggggtcgtaggtaccgggtacttaagtttaacgttttaacgtttttcggccgttggttactcgacgcgaggaaggtaagggaagggttaaccttaccgtagtccgtacgtgtaactcgttaagtcggtctacgtacttacgttacgttacgacgtaacgtaccggtcgggtacctcgtccgtctcgtgtagtcgagttgtacgttaggtacgggactagttacgttaccgtcgtcttacccgaccgtacacccgtcgtaccggttcgagtaaaccggttacttaaagtttcctttagaacctttaagtttaaccttaagttaacgttaaataaacgttaacgtacgtaacgttcggccccggttatacccggtacttaccggttccgtaaccgggtacgaaacggttacggtaacgaaacgttaaccgtaacgttacgcggttaccgacgtacccgaacggttntaccgtttatccg

SEQ ID NO: 42078 - DNA, 837 bp, Homo sapiens
  misc_feature: GYAE6OF02HS8UN.33.63.F08.1.454.CMB.1.raw
tcagtacacacactcacgaccggtgctcgatttagcgatcgtataaaggggcagaagtctctctcagtcaggacacagcatggacatgagggtccctgctcagctcctgggactcctgctgctctggctcccagataccgagatgtgaccgtccagatacgacccagtcctaccattccctcctgtctagctataccgagggtagggacgaacgaaggtacgttacccaacctattaccgtaccgttccgggaccggggacggtacggtaccggggtaacttaactttttacgtttaaacggttttttttcgggcccgtttaggttaacgtaccgtacggacgtaaggaagggtaaaggggaaacgggggttaaccgtttacccgttaaacggtacccgttccggttagttacttacgttacggttagggttacgaccttaccgttacccgtttaacgtttcgaacttaaggtaccgggtaccgggttaccccgtattcccgttcggtacctttacggacggttcgggtacggttacgggttagggttaggtttacgggtactttaagggttacctttccgtaacttcccgtaaccgttaccgttccaaccggtaccgttaccgcggacgtacgtacgttaggtaacgttttgtttaaccgactttaactttagttaaccgttaccgtaaagttaacgttcaaggttaccgtaacggtccttaccgtcgttaaccgttccggttacgtcccggttaaggaaccgtttaagaaccggttaaacgtaacccaaggtttaaccgtggtaccgacgttaccgtaaccaccttaggttaccc

SEQ ID NO: 42079 - DNA, 771 bp, Homo sapiens
  misc_feature: GYAE6OF02G3JFI.33.63.F08.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagtacacacactcacgaccggtgctcgatttagcgatcgtataagggggcagaagtctctctcagtcaggacacagcatggacatgagggtccctgctcagctcctgggactcctgctgctctggctccagataccagatgtgacgtccagatgacccagtcctccatccctcctgtactgcatcaggtggganacgagacgtccacatcactggccgggagaggtcggatatttactagtttttcggctgtatcgtagcgagaggaaggaagggtagttcctaaggaccttccctaggtacttcgtaagttcgggtcgactacgttacccgtagtttcggacctaacgttccggacggggttaccctagttacctccgtcttaacgnggtggccggtaggttcggttagtttacgggactacgttactttaccgaacgtttcccgtaccgtaaacccgggtcctaaacccgtccgttaccggtacgtaccggtacggttaccgttaagggttaaacgtttacgtttttaaccggaaccttttaaaccgttttaaagtttcccgttaaagggttaaaccttaaaaaccggtttgtaaccggtaacgtaacgggttcccgtacccgttaccgtttaacgttacccggtttaccccggggtaccgtttaacgggggtaaacccgttaaagggttaaccggtaacccgtaaaccggttaaaccgtacggttacggtacgggtactacccgggtaacctaccggttataccgg

SEQ ID NO: 42080 - DNA, 838 bp, Homo sapiens
  misc_feature: GYAE6OF02JTFQI.33.63.F08.1.454.CMB.1.raw
  modified_base (210)..(210): a, c, t, g, unknown or other
  misc_feature (210)..(210): n is a, c, g, or t
tcagtacacacactcacgaccggtgctcgatttagcgatcgtataagggggcagaagtctctctcagtcaggacacagcatggacatgagggtccctgctcagctcctgggacctcctgctgctctcggccttcccagactaccagatgtcgaccgtccagagtcgacccagtcctccactccctccctgtactgcatcgaggtcggganacagtacgtaccacctagtcctacggttcggcccggggtacgacgggtcgggaaccttactttaacgttaacgtttttcggccgttacggtacttacacggacaggtacggaagggtaacggggtaacgtttacccgtaaggtacccgtaccgttgtacgttcgttaggtacggtcgactacttaccgtacgtttacacgttaacgtccggtaccggggtccctacgttaccgtccgttaccgttacgtacggtacggacgttggttacgggttaacgtttcggggaatcggttactttaccgtactaccgtcccgtaaccggtacctacccggacgtacccgtaggtacccggtacgtacgttaacgggttaacgtttttacgttaacgtaccccttaaagttttacccgtaaacgttacgggttaaaaccttaaggttacgtaaccgtacgggtaccggtttaccggacccggtacccttaaccggttacccgtttacccggggtaccgttaccgggtaaacccgggtaaaaggttaaccggttaaacgtaacccggtaaaccggttaaccggtttaggtacccggtaccggttaaccccaaccgttaccgggtttaaccctccgg

SEQ ID NO: 42081 - DNA, 763 bp, Homo sapiens
  misc_feature: GYAE6OF02FWZ37.33.63.F08.1.454.CMB.1.raw
tcagtacacacactcacgaccggtgctcgatttagcgatcgtataagggggcagaagtctctctcagtcaggacacagcatggacatggagggtccctgctcagctcctgggactcctgctgctctggctccagactaccagatgtgaccgtccagatcgacccagtcctccactccctcctgtctcgcactcgaggtcgggacaccgagtacgtaccaacctacgtcctacggttcggcccggggaacgtacgggtacgggtaactaacttttaacgttaacgttttttcggaccgttaggttacacgtaaggtcaaggaggtaacggggaaacgggtaacgtttccgaaggtccttaccggtagtaacttgtacggttcggactacctaacttaccgttacttacggacttaacggtccggtaccgggtcctaagttcctcgtacgttcgaggtacgtgtaacggttgtacggtggaactcgttaactccgtacttacgccggtaacctcgaactcgtacgtcgtacgaccggtactagttagtttacgtttcgtaaccttaaacgtttactttaccgaaggttaaaccctaaaggttaccgttacgtaacgggttacgacccgggttacctccggttaccgttacccggtcccgggtaacgttaaccggaaccgttaaacggggtaaactaaccggtaaaccgttaaccgtaacggtttcggaccgtagtaacccgtaccgtaacccgttacgttcccgg

SEQ ID NO: 42082 - DNA, 621 bp, Homo sapiens
  misc_feature: GYAE6OF01DUWHK.36.24.C02.1.454.CMB.1.raw
  modified_base (278)..(278): a, c, t, g, unknown or other
  misc_feature (278)..(278): n is a, c, g, or t
  modified_base (443)..(443): a, c, t, g, unknown or other
  misc_feature (443)..(443): n is a, c, g, or t
tcagtacgctgtctcacgaccggtgctcgatttagtacagatcgttagggaaagggacccaaaaccacacccctccttgggagaatcccctagatcacagctcctcaccatggactggacctggagcattccttttcttggtggcagcagcaacaggtgcccactcccaggttcagctggtgcagtctggaggtgaggtgaagaagcctggggcctcagtgaaggtctcctgcaagacttctggttacagtctttacagctatggtatcaactgggtncgacagacccctggacaagggcttgagtggatgggatggatcagcgcttacaataggtaaaacacactatgacaacagaagcctaccaagggcaagagtcaaccatcgaccacagagacatccacgagaccacacgacctaacgagtagggacggttggggaacnccgtaggaagacttaccgtggaaccgaacgtaccggggaccccgttattaacgttaccgttgggttacggaccgtaaaggaacggttaacgaagttaaacttaggtttaacgttaaagtaggtaaacgttaaaccgggttggggaacccgtaacggggaaaccccgtgggttaccccg

SEQ ID NO: 42083 - DNA, 644 bp, Homo sapiens
  misc_feature: GYAE6OF01D77DL.36.24.C02.1.454.CMB.1.raw
  modified_base (394)..(394): a, c, t, g, unknown or other
  misc_feature (394)..(394): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagtctttactagctatggtatcaactgggtgcgacagacccctggacaagggcttggagtggatggggatggatcaggcgacttacaataggtaaaacacactatgacacagaacgctacgagggcagactcaacatacgaccanaacgagaacactaccaacgagacaacgacgaccctaacgagtagggtaacggtttgggggacgtcccgtaggagacgttcgtacggaccggaacgtacccgggtccttaacgttacttacggttcggtaggaccggtacggaagttaacgtaaacgtaaagttagtttaacggttaaagttacgggaaacgtttaaccgggacgggggaacccggtaaacggggaaacccccggtaagggttaacccccg

SEQ ID NO: 42084 - DNA, 619 bp, Homo sapiens
  misc_feature: GYAE6OF01D97BF.36.24.C02.1.454.CMB.1.raw
  modified_base (406)..(406): a, c, t, g, unknown or other
  misc_feature (406)..(406): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagagcctggggcctcagtgaaggtctcctgcaagacttcgtggttacagtcttttactagcttagtggtatcaacgtgggtgacgacacgaccctggacaagggcttgagtggagtgggatgggatcgaggcgtacgttaagaaagttacggtaaaaacacaacgtatcgacaacgagaacgctacgaggcagacgtcaactanacgaccaagagaacgacaacgtcccgaagacacaacacgtaccctagagtagggagttggggactccgttagacgtactcgaacggacgaccgtacggtccttagtacttaccggtgcggtacgaggtaacgtaacgagtaaattagttaagtaaagttaggaacgttaacgggtaccgggtaacccggaacgggtaacccgtggtaaccccg

SEQ ID NO: 42085 - DNA, 155 bp, Homo sapiens
  misc_feature: GYAE6OF01A7X3P.36.24.C02.1.454.CMB.1.raw
  modified_base (154)..(155): a, c, t, g, unknown or other
  misc_feature (154)..(155): n is a, c, g, or t
tcagtacgctgtctcacgaccggtgctcgatttagtacagatcgttagggaaagggaccaaggtggaaatcaaacgaactgtggctgcaccatctgtcttcatcttcccgccatctgaagacagcgtactgagcgggctggcaaggcgcatagnn

SEQ ID NO: 42086 - DNA, 772 bp, Homo sapiens
  misc_feature: GYAE6OF01B6JL8.36.24.C02.1.454.CMB.1.raw
  modified_base (261)..(261): a, c, t, g, unknown or other
  misc_feature (261)..(261): n is a, c, g, or t
  modified_base (334)..(334): a, c, t, g, unknown or other
  misc_feature (334)..(334): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagccgtggggcctcagtgaaggtctcctgccaagacttctggttacagtctttacngctatggtatcaacgtgggtgcgacacgtacccctggacaaggggcttaggagtggagtggggatgggatcgngcgtcttaacaagttaaggtaaaaccactaacgtaagtagaaacgaaggaacgtccgtacggaacggggactagggaacgttaccaaccctaagtaccggaaccaacgaaggaaccgtaccaacgtacccgaaccggacggaccaaccgaacgtacccgtaagtaacggtaggggtaacggtttacgggggaccgtaccgttagggaacggtagttcggtaacgaaccgggaaccgtacccggggtccgtttaacgttaacgtttaacggttcggtaaccggtaccggaaagttaaccggttaaacccgaaaggttaaaacgttaagtttaaggttaaacggttaaccgggtaaacgggtttaaacccgggtcggggggaaaccccgtaaaccggggtaaaccccggttaaaccggggtccccgttaaaccccccggg

SEQ ID NO: 42087 - DNA, 634 bp, Homo sapiens
  misc_feature: GYAE6OF01DUU5B.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcgagtgaaggtctcctgcaagacttctggttacagtctttactagctatggtatcaacgtgggtgcgacacgacccctggacaagggcttggagtggagtgggatggatcgagcgtcttaacaagtacggtaaaacacaactatcgacaacgaagaacgctaccgaagggcagagtaccaacacgtacgaacccacgaagaacgacctaactaccgaacggacgaccaaccgaacggtaccctaacgagttaggggacggtttagggggacgtccgttaggaacgtactcgtacggaaccggaccgaccgggtacccgttacttaagttacgtagtcggacggagtaagtaacgaagtaattagttagtaaagtggtaaattacggacggggacaaccgggaacccgtggtaacccg

SEQ ID NO: 42088 - DNA, 568 bp, Homo sapiens
  misc_feature: GYAE6OF01DIAVL.36.24.C02.1.454.CMB.1.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttctggtggcagcagcaacaggtgcccactcccaggttcagctggtgcagtctggaggtgaggtgaagaagcctggggcctcagtgaaggtctcctgcaagacttctggttacagtcttactagctatggtatcaacgtgggtgcgacagacccctggacaagggcttgaggtggagtgggatggatcgagcgacttaacaagtacggtaaaacacaactatcgacaagaggaagcctaccgagggcaaggacgtcactancgaaccanagacacatccagacgcacgaagcctacgagtcggaggttacggggacgtccgtagagtactcgtaggaccgacgaccggtccgtacttagttacgtggtcacggtagagtacaagtaatagttgaatggaacgtaggacggggacaacgggaccgtggtacccg

SEQ ID NO: 42089 - DNA, 789 bp, Homo sapiens
  misc_feature: GYAE6OF01DOW4H.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttctggtggcagcagcaacaggtgcccactcccaggttcagctggtgcagtctggaggtggaggtagaagagccgtggggccctcgaggtgaacggttcctcccgttagaccaaaggtacctttcgaacggtacttaacctaccctttcaacgtagttttaataggaaaacttccgaaaccgttgggattcggacgtaacgaccggtaccccgttagggaacgacgggttcgttagggtacggtagggaggtgggtagtacggtactacggacgccgttacttaaaccgaaggttaacggtaaacaaccgttaaatttagtaacggtaaactaaacggttaacggttaccggagggtaaccgaagttacggtacccaaccgtaacgtaccggaaacccaaaccgtaaacctaccaacccgtacccgaacggaacctaccgaacgaccgtaaccctaacgtacggtagggacgtacggtacggagggtaccgtcggtacgagtacgtcgtaacggacgaccggtccgtacgttagtttacttaggttgggtacggtcggggggtagggggttctaggggttcgacggttccgtaccgtaccgtgaccgttcggaaaccgttaccgggtaacggttcggtccccgggtaccccggg

SEQ ID NO: 42090 - DNA, 679 bp, Homo sapiens
  misc_feature: GYAE6OF01DZJHR.36.24.C02.1.454.CMB.1.raw
  modified_base (362)..(362): a, c, t, g, unknown or other
  misc_feature (362)..(362): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctgggaggtgaggtgaagaagccgtggggcctcgagtgaaggtctcctgcaagtacttcgtggttacagtctttactagctatggtatcgaacgtgggtcgcgtacacgacccctaggacaagggtcttggagtggagtgggatggatcgagtcgtattacaagtaggtaaaacncgtaactatgacaacgagaacgctacgaagggtcaagtacgtacaaccgataccggaaccacgaagacgaaccacgtacccgaacggacacgaaccgacgacccgttaacgaggttacgggtaacgggtttggggacctccggtaggacgtagtccggtaacggaacccgaaccgtaccgggtaccgttacgtttaacgttaacgtggttacgaaccggtaggaaacgttaacgaagttaaagtttaggttaacgttaaagtaggtaacgttaacgggtacgggaaccgaaccggggtaaccctacgggtaaccccg

SEQ ID NO: 42091 - DNA, 757 bp, Homo sapiens
  misc_feature: GYAE6OF01EA01A.36.24.C02.1.454.CMB.1.raw
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagccgtggggcctcagtgaaggtcctccgtgacaagtactttcgtggttacagtcttttacagcttagtggtatcaacgtgggtncgacgacgacccgtggaacgaggtcttgagtggagtggggatgggatcgngcgtactttaacaaagtacggtaaaaacactaactagtacgaccgtaacgaagtaaccgccgtaccccggaaaggggtccaaggtaaccggttaccaaacccgaacgttaccgaaacccccgaacgaacggaaccggtaacccaacccgtaacccgaaaccgggaacgaccctaaaccggtaaccgtaccccgttaacgaagggttacggggttacggggtttacgggggaccgtaccggttaggaacggttacgtaccggtaacggaaccggtaccgtaccgggtacccgttacttacgtttacgtggtacgtacggtaaacggtacggttaacgaaagttaatttacgtttaagtaaaggtaggtaacggtaacgggtacgggacccgaaacgggtaacccgtacggtaccccgg

SEQ ID NO: 42092 - DNA, 624 bp, Homo sapiens
  misc_feature: GYAE6OF01BW8XB.36.24.C02.1.454.CMB.1.raw
  modified_base (613)..(613): a, c, t, g, unknown or other
  misc_feature (613)..(613): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagtctttactagctagtggtatcaacgtgggtgcgacagaccctggacaggcttgagtggatgggatggatcagcgacttacaagtaggtaaaacacactatgacacgagaacgctacgagggcaagacgtcaacgatacgaccaacgacgagaactacgtaccgaacggacgaccgaacgacgtaccctaacgagttacgggacgggtttggggacgtcccgtaggacgtacgtcgtacggaacgaccgtaccgggtcccttagttacgtttacgtcggtacggtacggaaggtaagtaacgaagtaagttagttagtaagtaggtaagtaacgggtcggggaacccgaacgggtaaccccgngggtaaccccg

SEQ ID NO: 42093 - DNA, 729 bp, Homo sapiens
  misc_feature: GYAE6OF01E0MOH.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagagccgtgggcctcgagtgaaggtctctgacaagtacttctggttacagtctttactagcttagtggtatacgtaacgtgggtgacgacacgaccccgtaggacgaagggtcttggaggtggagtggggagtgggtactcgaggtaccgtactttaacgaagttaacggtaaaaaccaccgtaaactaagtcgaccgaaacgaaggaaaccgtccgttacccggaagggaccgtaaggtaacgtacccaaacgtacgtacccgaaccacgaagaacgaactacgtaccccgaagacgaccaacgtaaccgtacccaacgtaggtacggggtacgttaggggacccgtcgtaggaacgtctccgtacggaaccgaccggtaccgggttaccttacgttacgtttacgtagggtacggtacggaaaggtaacgtaagtaagttaaagtttagttaaacggttaagggtaggttaaaccgtaacgggggtaccgggaaccccggaaacgggtaacccgacggtaccccg

SEQ ID NO: 42094 - DNA, 654 bp, Homo sapiens
  misc_feature: GYAE6OF01AIFR2.36.24.C02.1.454.CMB.1.raw
  modified_base (254)..(254): a, c, t, g, unknown or other
  misc_feature (254)..(254): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtacgctgtctcacgaccggtgctcgatttagtacagatcgttagggaaaggggacccaaaaaccacacccctccttgggagaatcccctagatcacagcctcctcaccatggactggacctggagcattccttttctggtggcagcagcaacaggtgcccactcccaggttcagctggtgcagtctggaggtgaggtgaagagccgtgggcctagagtgaggtctcctgacaagtacttcgtggttaacngtactttacagcttagtggtaatctaacgtgggtgacgacacgacccgtaggacgtagggtcttaggaggtggatggatggatcgngcgtacttacgaagttacgaaaaccncacgttaancggacaacgaggaaccgcgtacggaacgggtcaagggacgtacaaccgtataccgaacctaacgaggaacactaccgtaccgaacgagaccacgacgtaccacgtggtagggtacggttgggactccgtagacgtacgtcgacgaacgtcaccgttcgaccgtttactaacgttcggtacgtacggtacggtagtaagtaacgtaacgttaaagttgttaacgtaaagtacgggtaaacgtaacgggtcggggaacccgtaaaggggacccgtaaccgg

SEQ ID NO: 42095 - DNA, 875 bp, Homo sapiens
  misc_feature: GYAE6OF01CRFU2.36.24.C02.1.454.CMB.1.raw
tcagtacgctgtctcacgaccggtgctcgatttagtacagatcgttagggaaaggggacccaaaaaccacacccgtccttgggagaatccctagatcacagctcctcaccatggactggacctggagctatcctttcttggtggcagcagcaacagtgccactccaggttcagctggtcgctagtctggagtgaggtgaaggaacgccgtcgggcctcgacgtggaacggtcctccgtagtacgaacgttactttcgtacggtttaacgacggttactttaacgtacggtaccttaagttacgggttactacgaaacgttcgggtacgtacgaacgaccgtaccgtacggaacgtaagggtctttaggaggttaggagttacgggaacgtacgggactttaccggacggtaccgtacgttaaacgtaaagttaccgggttaaaaaccactaacgttacgttcgaaccgaacgaaacgggtaacgttcccgtaccggaaacggggtacctaagggtcccggttaaccaaaccggtaccgttaaccgggaaacccgaacggaaacgggtaaccgaaccgttaacgaacccggtaacgtaacgttacccgaaacggttacccgacccgttttaagaggtttaccgggaaacgggtttcggggaactacccggtagaaaccgggttacgtaccggaccggttaacccggaaccgggttccgggttacccgtttaacgtaccggtttacgtacgggttacgtaacgggtactaaacgggtagttaaaacggagtttttaacggtagttaaacgttacggtaaacgtttaacccgggacggggtacccgtaaacggggtacccgttaccgggttaaccccg

SEQ ID NO: 42096 - DNA, 589 bp, Homo sapiens
  misc_feature: GYAE6OF01A6KO9.36.24.C02.1.454.CMB.1.raw
  modified_base (578)..(578): a, c, t, g, unknown or other
  misc_feature (578)..(578): n is a, c, g, or t
tcagtacgctgtctcacgaccggtgctcgatttagtacagatcgttagggaaaggggacccaaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcgagtgaaggtctcctgcaagacttctggttacagctttactagctatggtatcaactgggtgcgacagaccctggacgaagggcttggagtggagtgggatggatcgagcgactacaataggtaaaacacgactatgacacagaagctcgaggcagacgtacacgatcgaccacacgagacactccgaacgagaccacacgacctacagtagggaggttacgggagtcgtagacgtagtacaggaccggaaccacgggtccgttacgttactacgtacggtggacggagtagtaacgtagtaattagttagtaagttaggaagttaacggacggggtaacccgaacggggtaaacccgnggtaaccccgg

SEQ ID NO: 42097 - DNA, 756 bp, Homo sapiens
  misc_feature: GYAE6OF01AXCJ5.36.24.C02.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
tcagtacgctgtctcacgaccggtgctcgatttagtacagatcgttagggaaaggggacccaaaaaccgaccacccctccttgggagaatcccctagatcacacgctcctcaccagtcggactggacctggagcatccttttctggtgcagcagcaacaggtgcccactcccgaggtttcagctggtgcagtctggaggtgacggtgaagaacgccgtagggcctnacgtgaacggtctcctgacaagtccttcgtaggttacagtcttttacncgcttagtggtatactaacgtgggtgaccgtacgacgaccccgtaggacgaacggtcttggaggtgggtacttcggggatcgggtagtacgacggacgtacttaacgaagttaacggtaaaacactacgtagtacgaccgtaacgaagtaacgccgtaacggacgggtacgaacggtaacgtcctaacccgtagttaccggaaccgaaccgaaggaaccgaaccgtaaccgtacccgaaccggacgaccgaacccgtacgacccgtaacgtacggtacggggtacgttcgggggactacggtacggtaccgtacgtccggtaacgaacccggtaccgtacccgggtaccgtttacgttaagttacccggttggtaacgggtacggtaacgtaacggttaacgaaggttaaacttaggtttaggttaacgaggtaacgttaacgggtacggggacaaccggggtaaacccgtcgggtaccccg

SEQ ID NO: 42098 - DNA, 620 bp, Homo sapiens
  misc_feature: GYAE6OF01BQYJO.36.24.C02.1.454.CMB.1.raw
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (469)..(469): a, c, t, g, unknown or other
  misc_feature (469)..(469): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatcctttcttggtggcagcagcaacaggtgcccactcccaggttcagctggtgcagtctggaggtgaggtgaagaagccgtggggcctcgagtgaaggtctcctgcaagcttcgtggttacagtctttactagctagtggtactcaacgtgggtgcgacncgacccctggacaggcttgagtggactggatggatcaggctcgttaanagtacggtaaaacncgtactatacgaacgagacgctaccgaggcagacgtccacacgtcaccgaacacgacgtaacacgtaccgaacgtacgacccagtaccgtaccacgtagtacgggtagttacgggacnccgtagagacttcggtcgtaaccgacggtacggtcccgtattaacgttctcggtacgcgtagtaccgtaacgtaagtaccgttatacggttagtacggtaacgttacggtaccgggacgtaaccgggtacccttacggcccgttaaccccg

SEQ ID NO: 42099 - DNA, 707 bp, Homo sapiens
  misc_feature: GYAE6OF01B9APT.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagagcctggggcctcgagtgaaggtctcctgcaagtacttctggttacagtctttacgtagctatggtatcaacgtgggtgcgacacgacccctggacagggcttggagtggagtgggatggatccgagcgtacttaacaaagttacggtaaaaacactacgttaactgacaacgaagaacgtcctaccggaagggaccaaggacgtaccaacctagtaccgaaccaacgaagaacgaacaactacccgaacgacgaccaacgaacgtaccctaacgagtacggacgtacgtacggaacggtacgtaccgtaggacgtaacgtacgtacggaaccgaaccggtaccgggtaccggttagttaacgtttagttcgggtacgggtacgggggttacggggggggttagtttagggggttacgggttcgggtaccgtaaccggtaacccggtacggttaccgttacgggtaacccgttaaacccggtaaaccgggtttaccccggggg

SEQ ID NO: 42100 - DNA, 724 bp, Homo sapiens
  misc_feature: GYAE6OF01DU2ZR.36.24.C02.1.454.CMB.1.raw
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtcgtgggaggtgaggtagaagagccgtggggcctgagtgaggtctcgtgacagtcttntggtacagtctttactagtcttagtggtataccaaggtgggtcgacgtaccaccggtaccccgtagggacgtaacgggtctttgggaggtagggngtagggagtggatcaggacgtacttaataagtaaacggttaaaacactaagttnacgacaacaaggaaccncgtaccggagggtacaacggtagtaccaacagtacgaacccagtacgaacgtaccaacgtaccgaacgacgtacgaccgacgtacccttaacgaagggtcggtaaggggtaccgggacgtaccgtaggtaacgtacgtacgtaacggaaccgccggtaaccgggttacccgtttacgttaacgttaccggttggtaccggtacggaaacggtaacgttacgaaagttagttaaaggtttgtaaacggttagggtaaacgttaccgggtaacggggacccgaaaccggggttaaccccgcgggttaacccccgg

SEQ ID NO: 42101 - DNA, 727 bp, Homo sapiens
  misc_feature: GYAE6OF01E58Y7.36.24.C02.1.454.CMB.1.raw
  modified_base (270)..(270): a, c, t, g, unknown or other
  misc_feature (270)..(270): n is a, c, g, or t
  modified_base (653)..(653): a, c, t, g, unknown or other
  misc_feature (653)..(653): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtcgcccactcccaggttcagtcgtggtgcgtagtcgtgggaggtggagggtagaagaacgccgtggggcctcgaggtgacggtcctccgtgacaagtcttcgtaggttacngtctttacgagcttagtggtactacgtaacgttgggtcgaccgaacgtaccggtaccccgtagggaacgtaacgggtcttaggaggtggagttgggagtggtactcgagtccgttactaagaaacgtaacggaaactactaacgtataccggactaacgaacggtaccggtccgtaacgggaggacgtaacggaccgttacccaaccgtaacgtacccggaaccctaacggaacggaaccaaccgtaaccgtacccgaaccgacgaaccgtaccgaccgtaaccgtacggtaggtaggggtaccggttacggggactacggtaggagtaccttcggaacctacgaccggtaccggtcgttaccgttagtagtcggagacgganaacgtagatttaggtaagttagtaaggagtacgggtaccgggtacggaaccggaccggtaccgtacggtacccg

SEQ ID NO: 42102 - DNA, 661 bp, Homo sapiens
  misc_feature: GYAE6OF01EZMIA.36.24.C02.1.454.CMB.1.raw
  modified_base (109)..(109): a, c, t, g, unknown or other
  misc_feature (109)..(109): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (321)..(322): a, c, t, g, unknown or other
  misc_feature (321)..(322): n is a, c, g, or t
  modified_base (335)..(335): a, c, t, g, unknown or other
  misc_feature (335)..(335): n is a, c, g, or t
tcagtacgctgtctcacgaccggtgctcgatttagtacagatcgttagggaaaggggacccaaaaaccacacccctccttgggagaatcccctagatcacagctcctcnccatggactggacctggagcatcctttctggtggcagcagcaacagtgcccactcccaggttcagctcggtgcagtctggaggtgaggtgaagaagccgtgggcctcgagtgaaggtctcctgcaagctctgtacngttaccnttacgtagtactacgtacgtacgtaccgtaacgtacggtcgaccgacgtaccgtacccgtacggtacgnnaacggtacgtacngtaggtacggtaggtacggtagtacggtacgtacgtacgacgtaccgtaacgtaacgtaaacgtaaacgtaacgtaactacgtacgacgacgaacgacgtaccgtacgacggacgacgtacgaccgaacctacgtaacgaaccgaacgaacgaacgaaccgtaccaccgaacgaccgaccgaagcctaacgacgtacgacgtagggacgtacggtaggacgtacgtacgacgtaccgtacgacggtaccgtacgtaccgtaccgtacgttacgtacgtacgtacgtacgtaagtaacgtaacgtaagtaacgttcgtaacgtacgg

SEQ ID NO: 42103 - DNA, 782 bp, Homo sapiens
  misc_feature: GYAE6OF01AGZW5.36.24.C02.1.454.CMB.1.raw
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattcctttttcttggtggcagcagcaacaggtcgcccacctcccgaggttccaggctggtgctagtcgtgggaggtggaggtagaagacgccgtgggcctgagtgacggtctcctgacagtcttgtcggtanacgtctttanagtcttagtggttacncgtacggtggtgtccgacgaccggacccgtagacggtaggtcttaggaggtaggacggtagggagtcggtatacgacggtactaacgtttaacgaaaggttaaacgtaaaaccacgtaacgtacgtaccgaacgaaaccggtaacgtaaccggccgtaaccgggaacgggacgaacggtacccgtaaccgaaccgtaagtacccgaaccgaaggtaaccggaacctaacccgtaccgtaaccggaccggtaaacgacccgtaacggtaccccgtaacccggttagtaacggggttcgggttaacggggtacggacccgttggaacggtacggtcgtaccggtaacgacggtacccgtacgggtacctttactacggtcgtacggtagacggtaaagtaccgtaagtacgttaaggtttgtaaacgggttacgaacgttaaccggggtaacccggaccggggtaacccacgggacccccggttaacggtacccccg

SEQ ID NO: 42104 - DNA, 725 bp, Homo sapiens
  misc_feature: GYAE6OF01ALOKL.36.24.C02.1.454.CMB.1.raw
  modified_base (182)..(182): a, c, t, g, unknown or other
  misc_feature (182)..(182): n is a, c, g, or t
  modified_base (245)..(245): a, c, t, g, unknown or other
  misc_feature (245)..(245): n is a, c, g, or t
tcagtacgctgtctcacgaccggtgctcgatttagtacagatcgttaggtaaaggggacccaaaaaccacacccctccttgggagaatcccctagatcacagctcctcaccatggactggacctggagcatccttttctggtggcagcagcaacaggtgcccactcccaggttcagctggtncagtctggaggtgaggtgaagagccgtggggcctcgagtgaaggtctcctgacaagtacttgnggttacagtctttactagctagtggtactcgaacgtgggtgcgacacggacccctaggacaaggcttgagtggatggatggatcgagtccgacttaacgaagtacggtaaaaccactactagtgaccagtaagagctacggagggtacaggtacgtacaacgacgtacgacccaagagacgactacgtacccgacggacgtcaaccgacgtaccctaacgtacggtagggtaacggtttcggggacctaccgttaggaaccgtacgttccgtaacgggacccggtaacccgtacggggtaccccgttaattaacccggtttacggtacgggtaccggaccggtaaacggtacggttaaccgtaaacggttaaagtttaccggttaacggttaaacgttagggtaaccgttaaaaccgggggttccgggggtaaacccccggaaccggggttaaaccccggtccggttaaacccccccggg

SEQ ID NO: 42105 - DNA, 759 bp, Homo sapiens
  misc_feature: GYAE6OF01B7ADZ.36.24.C02.1.454.CMB.1.raw
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
tcagtacgctgtctcacgaccggtgctcgatttagtacagatcgttagggaaaggggacccaaaaaccacacccctccttgggagaatcccctagatcacagctcctcaccatgggactgggacctggagcattccttttcttgggtggcaggcagcaacgaggtcgcccacctcccgaggttcagcgtggtgcagtctgggaggtgaggtagaagagccgtggggcctcgagtgaggtctcgngnaagtaccttcgtaggttacagtcctttacgtacgtcttagtgtaataccgacggttgggcgtccgacgaccgaccccgtaggacgagggtcttggaggtaggaggtagggagtcggtatcggacgtcgtacttaacgtaagtaacgtaaaacacgtaactagcgacaacggtaacgaccgtccgtaccgagggtaccaggtaaccgtaccaccgtaacgtaccggaaccaagtaacggaaccgaacctaaccgtacccaaacgggacctaaccgaacgtaccggtaaccctacggtaacggggttacgggtacggggttacgggacgtaccggttaggaaccgttaccgttacgtacgggaaccggtaccgtaaccgggttcgtaactttacggtacggttacggtcggaaacggttacggacgttaaacgtaggttaaattaggttaagttacggtaaggacggttaacggggaccggggtaaccggaaccgggtaacccgtgggtaccccg

SEQ ID NO: 42106 - DNA, 699 bp, Homo sapiens
  misc_feature: GYAE6OF01BBH7I.36.24.C02.1.454.CMB.1.raw
  modified_base (411)..(411): a, c, t, g, unknown or other
  misc_feature (411)..(411): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctgggaggtgaggtgaaggaacgccgtgggggcctcgaggtagaagggtcctccgtgacaagtctttcgtggttacagtctttacgtagtcttatggtatactaacggtgggtcgacgaccacggtaccccgtaggaacggagggtcttaggaggtggagtcgggatggactcgagcgtacttaacgaagtaacggtaaaccactaactagtacgactaacganacggctaccggaggacacgactactaccgacgtacgaaccgacgagtacgacacgtaccaggactaccgaacacgtacctaacgtggtagggtgggtacggcgtccgttagacgtactacgtacggtaaccgaccggtccgtaccgttagtaacgttcgtaggtacggtaccggtaagtacccgaacgtaaggttacgttaaaggtttggaaacggttaacgggaaccgttaaccggggttacggggaaaccccgttacccgggggtaaaccctcggggtaacccccg

SEQ ID NO: 42107 - DNA, 849 bp, Homo sapiens
  misc_feature: GYAE6OF01BXFB3.36.24.C02.1.454.CMB.1.raw
  modified_base (157)..(157): a, c, t, g, unknown or other
  misc_feature (157)..(157): n is a, c, g, or t
  modified_base (261)..(261): a, c, t, g, unknown or other
  misc_feature (261)..(261): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcgttggtggcagcagcacnggtgcccactcctaggttcagtctggtgcagtcgtggtaggtggaggtagaaggagccgtggggcctcgagtggaacggtcctcgtgacagtcttctggttacngtctttacgtagtcttagttggttactacgtaacggtggtacgacgaccgaacgtaccccgtaggaaccggtaacgggtccgttaggacgggttggggaagggttcggggtaaggtaggggtaccgtaacggtcggtaccggttaacctttaagggtaaacggtttaaaccggttaaaaaccaaccggttaaacgtaacgttacggaaccgtaaaccgaagggaaacgtaccgtaaccgggaaccgggaacgtaacggtaccgggtaacccaaccgtaacgttaccggaacccgaagtaacggaccgtaaacgtaaccgacccggtaacgaaccgtaccacggtaaccaccgtaacgtacggtacgggtacgggtacgggaccggtaacggtacgtaacgggtactaccggtacggtaaccgacccggttaaccgggttccccgttaagtttacgtttacggtcgggttaaacggacggtaagtaacgttaaccgtaagttaggtttaaacggttaagtagggttaacggtacggtttaaaccggacggggtaacccggttaacggaacccggttccggtaaccccgg

SEQ ID NO: 42108 - DNA, 523 bp, Homo sapiens
  misc_feature: GYAE6OF02FW27W.36.24.C02.1.454.CMB.1.raw
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagctttacagctatggtatcaactgggtgcgacagacccctggacaagggcttgagtggatgggatggatcgagcgcttacaatggtaaaacacactatgacacagaagctacgagggcagacgtcaccatcgaccacagagacatccagagcacagccacatggagttgggganccgngagatctagacgacacggccgtctagttactgtgacgagagtacgaagaactagttgtaagtggatacggtagggaccagggacccaggtacccg

SEQ ID NO: 42109 - DNA, 645 bp, Homo sapiens
  misc_feature: GYAE6OF02G72FH.36.24.C02.1.454.CMB.1.raw
  modified_base (401)..(401): a, c, t, g, unknown or other
  misc_feature (401)..(401): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtctggaggtgaggtgaagaagcctggggcctcagtgaaggtctcctgcaagacttctggttacagtctttacagctatggtatcaacgtgggtgcgacacgacccctggacaagggcttgagtggatgggatggatcgaggcgtacttaacaattaggtaaaaacacaactatcgacaacagaagctaccgaggcagagtacacatcgaaccanagacgacactaccacgagacaacacgacctacgagtagggtaggttaggggactccgtagaaggtacgtcgtacggaccgacgaccggtacccgttacgttaacgttacgtaggttacgaccggtaggtaagtaaccgtaaaggttaaagttagtttaacggttaaagttacgggtaaacgttaaacccgggttacgggggtaacccggtaaaccggggtaaccccggtaagggtaacccccgg

SEQ ID NO: 42110 - DNA, 667 bp, Homo sapiens
  misc_feature: GYAE6OF02H8HCH.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagagcctggggcctcagtgaaggtctcctgcaagacttcgtggttaacagtctttacgtagctatggtatctaacgtgggtgcgacgacgacccccgtggacgaagggcttgaggtggaagtgggtatggaatcgaggctacttaacaagttacggtaaaacactaactagtacgacaacgaagaacgcctaccgaggggaccaggaacgtacacgaatcggaaccaacgaagacgaacataccgacgagacacgacgacctagacgttggacggttgggggactcccgtaggaacgtacgtaccgtaggaaccgaaccgtacccgggtaccgttactttaacgttaaccgtaggttcggacgtacggtacggtaaacgaaggttaaatttaagttaaggttaaacgttaaggtacgttaaccggtaggggacccgtaacgggaaaccccggtagttaaccccgg

SEQ ID NO: 42111 - DNA, 546 bp, Homo sapiens
  misc_feature: GYAE6OF02GNG0F.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagctttactagctatggtatcaactgggtgcgacagacccctggacaagggcttgagtggatgggatggatcgagcgcttacaatggtaaaacacactatgacacagaagctaccgagggcagagtcaaccatcgaaccacagagacatccaacgagcaacacgcctacagtggaggttggggagccgtagagatcgtaggacgacgacggccgttactaattacgtgtgcgagagtacgaagtaattagttagtaagtggaataacggtggggaccaacggggacccaggtacccg

SEQ ID NO: 42112 - DNA, 572 bp, Homo sapiens
  misc_feature: GYAE6OF02H837X.36.24.C02.1.454.CMB.1.raw
  modified_base (345)..(345): a, c, t, g, unknown or other
  misc_feature (345)..(345): n is a, c, g, or t
  modified_base (564)..(564): a, c, t, g, unknown or other
  misc_feature (564)..(564): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagctttactagctatggtatcaactgggtgcgacagacccctggacaagggcttgagtggatgggatggatcagcgcttaacaagtaggtaaaacncgaactatgacaacaagaagcctacgagggacagaagtccaaccatacgacccaagagagacataccaacgacgacaacacgcctaacagtacggaggttcggggagtccgtaggaagtatcgtaggaaccgacgaccgggaccgttactagttacgtgtagcgagacgtacgaagtaatagtgtaagtggtaataacggtcgggaccagggtaacccnggtacccg

SEQ ID NO: 42113 - DNA, 617 bp, Homo sapiens
  misc_feature: GYAE6OF02HNGLT.36.24.C02.1.454.CMB.1.raw
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
  modified_base (502)..(502): a, c, t, g, unknown or other
  misc_feature (502)..(502): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttcgtggttacagcttttactagctatggtatcaactgggtgcgacngacccctggacaagggcttgagtggatggggatggatcgagcgcttacaatggtaaaacncactatgacacagaagctaccgagggcagagtcaccatcgaccanagagacactccacgagacacgacgacctacagtcgggtagttgggggacgtcccgtaggaagtactcggtagaaccggaaccaaccgggtcccgttacttaacgtttaacncggttaggaccgtaggtacgttaaccgaaggtaagttaaagtttaggttaaaggttaggaacgtttaaccggacgggggttaacccgaacggggtaaccccgagggttaaccccg

SEQ ID NO: 42114 - DNA, 714 bp, Homo sapiens
  misc_feature: GYAE6OF02HSCVQ.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggagtgaggtgagaagcctggggcctcagtgaaggtctctgcagacttcgtggttacagctttactagctatggtatcaactgggtgcgacagacccctggacaagggcttgagtggatggggatgggatcgaggcgacttacgaagtaggtaaaacacaactagtacgacaacgaaggaacgaccgttacccgaaggggaccaaggtacggttaccaaccgagtacgaaccctaacgaacgaacggaacaaacgttcccgaacgaacggaccaaacgacgaccctaacagtagggtacggttacgggggaacgtcgtagggaacgtacgttaccgtaggaaccggaccgaacccggggtacccgttaccgttaacgtttaaccgtgttacggaccgggtaacggtaacggttaaccgaaaggttaacgttaaacgtttacggttaaaagttaggggttaaacttaaacgggtccggggggtaaccccgtaaacgggggtaaccccgtaaggggttaacccccgg

SEQ ID NO: 42115 - DNA, 609 bp, Homo sapiens
  misc_feature: GYAE6OF02IBGGQ.36.24.C02.1.454.CMB.1.raw
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagtacgctgtctcacgaccggtgctcgatttagtacagatcgttagggaaaggggacccaaaaaccacaccctccttgggagaatccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagctttactagctatggtatcaactgggtncgacagacccctggacaagggcttgagtggatggggatgggatcaggcgcttacaatggtaaaacanactangcacagaagctaccagggcagagtacaccatgaccacagagacataccaagacgcaacagccctaacagtacgggagttggggacgtcctaggagtagtcgttaggaaccggacaccggggtaccgttacttaacgttaactggtttacgacgtacggaacggttaacgaagggtaacttaagtttaggtaaattagggtaagtttaaaccggttacggggggacccctaacggggggtaacccccaggggttaaccccg

SEQ ID NO: 42116 - DNA, 639 bp, Homo sapiens
  misc_feature: GYAE6OF02I3AX7.36.24.C02.1.454.CMB.1.raw
tcagtacgctgtctcacgaccggtgctcgatttagtacagatcgttagggaaaggggacccaaaaccacacccctccttgggagaatcccctagatcacagctcctcaccatggactggacctggagcatccttttcttggtggcagcagcaacaggtgcccactcccaggttcagctggtgcagtctggaggtgaggtgaagagcctggggctcagtgaaggtctcctgcaagacttctggttacagtctttacagctatggtatcaacgtgggtgcgacagacccctggacgaagggcttgagtggatgggatggatcgaggcgtacttacgaagttggtaaaaacactactataggacaacgagaacgctaccggaagggacaagacgtaccaaccagtacggaacccaacgaaggaacgacaacgtacccgaacggagaccaacgtacgacctaacaggtacgggtaggttacgggggactccgtagacggtaatccggtagaaccggaccgaccgggtacccgtattaacgttacgtggtacgacggagtaaggtaaccgaaggtaaacttggttaagtaacgtaggtaacgtaacggttcggggaccgaacggggtaacccagggtaaccccg

SEQ ID NO: 42117 - DNA, 688 bp, Homo sapiens
  misc_feature: GYAE6OF02F6DAT.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagccgtggggcctcgagtgaaggtctcctgcaagcttctggttacagctttacagctatggtatcaactgggtgcgacagacccctggacaagggcttgagtggatgggatggatcgagcgacttaacaagtaggtaaaacacaactatagaccacgaagaacgctaccgaagggtcaaggacgtaccaaccgatacgaacccaacgaaggacggaacaacgtaccccgaacggacgaccaaccgacggaccctaaccgaggttacgggtagggttgggggaacgtccgtggaacggtactcgtaggaccgaccgaaccgggtcccgttagttaacgttacgtggttacggacggtagggacggggtacgggtttaatttaagttacggttaaggttttaccgggttttagggggttaacctttttcccccggttttaggtaaccggtttaccgggttacgggggtacccgttaaaccggggg

SEQ ID NO: 42118 - DNA, 586 bp, Homo sapiens
  misc_feature: GYAE6OF02IZB00.36.24.C02.1.454.CMB.1.raw
  modified_base (250)..(250): a, c, t, g, unknown or other
  misc_feature (250)..(250): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacngcttacagctatggtatcaactgggtgcgacacgacccctggacagggcttgagtggatggggatggatcgagcgtcttaacaagttaggtaaaacacactatgacacagaacgcctcgaggcagagtcaccancgacacgagagacatccacgancacagacctacgagtggaggttcggggactccgtaggagtacgtcgtacggaccgacgacgggtcccttacgttaacttacggtagtcggacgtaggtaacgtacgaagtaaattaacgttagttaagtaggtaacgtaacgggtacgggaccggtaacggggtaccctagggtaccccg

SEQ ID NO: 42119 - DNA, 695 bp, Homo sapiens
  misc_feature: GYAE6OF02HIUFZ.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagagccgtggggcctcagtgaaggtctcctgcaagacttgtggttacagtctttacagctatggtatcaacgtgggtgcgacacgaccccgtggacaagggcttggaggtggagtgggatgggatcgagcgacttaacaagtacggtaaaacacgaacttatcgacaacaaggaacgtccgtaccgaacggggcaaggtacgtaccaaccgtagtaccggaacccaacgaacggaacgaacaacgtacccgaacggacggacaacgacgtaccctaacgagttacgggtacggttaggggacgtccgtaggaaggtagttaccggtaggaaccgaccgtacccgggaccgtttaccttaagtttaaccgttggttacggtacgggagtaacgtaacgtaaggtaaatttaaggtttaagttaaaggttaggtaacgttaacgggtacgggtaacccgggtaacccgggtaacccggtaacgggttaaccccgg

SEQ ID NO: 42120 - DNA, 595 bp, Homo sapiens
  misc_feature: GYAE6OF02GO0Y8.36.24.C02.1.454.CMB.1.raw
  modified_base (243)..(243): a, c, t, g, unknown or other
  misc_feature (243)..(243): n is a, c, g, or t
  modified_base (452)..(452): a, c, t, g, unknown or other
  misc_feature (452)..(452): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtctggaggtgaggtgaagaagcctggggcctcagtgaaggtctcctgcaagcttcnggttacagtctttacagctatggtatcaactgggtgcgacacgacccctggacaagggcttgagtggatgggagtggatcgagcgtacttacaagtaggtaaaacacataatgacagaagaagctcgaagggcaagacgtcaaccatacgaaccagagacgaccacgtaccaacgaaacacacgacctaacagtggaaggttggggacncgtagagtagtcgagacgacgacggccgtacttagttacctggtgacgaagacgtaacgaagtaacgttaagttacgtaagttaggaacgttaaacgggtcgggaacccgaagggtaaccccgtagggtacccctaaccccgg

SEQ ID NO: 42121 - DNA, 644 bp, Homo sapiens
  misc_feature: GYAE6OF02FU3B2.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtctggaggtgaggtgaagagccgtggggcctcagtgaaggtctcctgcaagacttctggttacagtctttacagctatggtatcaagtgggtgcgacacgaccccgtggacgaagggcttagagtggagtgggatggatcgagcgtacttaacaagtaggtaaaaccacaactagtgacacgaagaacgcctaccgaggcaagagtcaccatcgaaccacagaacgacaactccgaacgacgaccaaccacgaccctaactagtagggtacgggttaggggaccgtccgtaggaagtagttccgtacggaccggaaccgacccgggtaccgttacttaacgttaccgtggtaccgacggaagtacggtaacgaagtaaagtttagttaagttaacgttaggtaacttaacgggtacggggtaaccggtaacgggtaaccccgtagggttaacccccg

SEQ ID NO: 42122 - DNA, 743 bp, Homo sapiens
  misc_feature: GYAE6OF02H51ZI.36.24.C02.1.454.CMB.1.raw
  modified_base (364)..(364): a, c, t, g, unknown or other
  misc_feature (364)..(364): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctgggaggtgaggtgaagaagccgtggggcctcagtgaaggtctctgcaagtacttctggttacagtctttactagctagtggtatcaacgtgggtgcgacacgtaccctggacaagggtcttagagtggatgggtatggatcgaggcgtacttaacgaagttaaggtaaaaaccanaacttaagtacgacctaagaaggaacgaccgtaccggaacgggacaacggtaacgtaaccaccctagtacgaacccaacgtaacggaacggaacctaacgtaacccgaaccggtacgaaccaacgaacccgacctaactaacggttacgggtaacggggttaggggaacgtccgtaggaacggtacggtaccgtacggaacgtaaccgtacccgggacccgtttaacgttaacgtttacggtacgttacgggaacggtacgtaacgggttaacgtaaacggttaactttaaaggttaacggtttaaagtacgggtaaacggttaaccgggtaacgggggtaacccggtaaacggggtacccgttaccgggtaacccggg

SEQ ID NO: 42123 - DNA, 761 bp, Homo sapiens
  misc_feature: GYAE6OF02IP7R8.36.24.C02.1.454.CMB.1.raw
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagtacgctgtctcacgaccggtgctcgatttagtacagatcgttagggaaaggggacccgaaaaaccacacccctccttgggagaatcccctagagtcacagctccctcaccatggactggaccctggagcatccttttcttggtgcagcagcgaacaggtgtcccactcccaggttcagcgtggtcgctagttctggacggtggaggtgaacgacgcccgttggggcctcgaggttcgaaggtctcctggccaagcctttcgtggttactagtctttacgagctagtaggtactcaacgttcgggtgcgacctacgccccgtaggacaacgggtctaggtgtgtacgtcgggtagtggtactcgacgacttacctaagaagtacgtaaaacncgtagtacgcgtacgacgtaagacgtcctagaacggtcagtacncctacacgtacgaacgacgtagacgtaacgactcccgaaagaacccgtacgtcgtaacccttacgtacgtaggggtacgttacggggacgtcccgaggtaacgtaccgttgtaccggtacctacccgggtaacgttcccggtttaacgttaaccgttaccgggttagacccgggtacgtacgggtaacgtaaaggttaccgttaaaaggtttacccggttaagggttaaccggttaacggtaacccggtttaaccgggaacccggggttaccgggtaacccgggttaaaccccgggttcggttacccccccgttaacccggg

SEQ ID NO: 42124 - DNA, 574 bp, Homo sapiens
  misc_feature: GYAE6OF02H8HBK.36.24.C02.1.454.CMB.1.raw
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
tcagtacgctgtctcacgaccggtgctcgatttagtacagatcgttagggaaagggggacccaaaaaccacacccctccttgggagaatcccctagatcacagctcctcaccatggactggacctggagcatcctttcttggtggcagcagccacaggagcccactcccaggtgcagctggtgcagtctggggctgaggtgagaagcctggggcctcagtgaaggtctcctgcaagacttcnggatacaccttcaccggctactatatgcactgggtgcgacgaggccctggacaaggggcttgagttggatgggatgggatcgaaccctagagtgggtggcacaactagtgnacagaagtttcagggcaggggtcacatgaccgagggacacgtccatcagcacagtctaacagttggagcgtgagcagggctaggagagtaccgtgaccgacgaccggacccggttgtacttaacgtggtcgacgtaggagggtcggggtattaggttggagtttaccggtttgggggtaacgttttccccggtttaggtacctttacggtggggtacccgg

SEQ ID NO: 42125 - DNA, 616 bp, Homo sapiens
  misc_feature: GYAE6OF02FZUV3.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtctggaggtgaggtgaagagcctggggcctcagtgaaggtctcctgcaagacttctggttacagtctttaggagtatgcaatcaccgtgggtgcgacaggcccctggacgaagggcttggagtggagtgggagtggatcgaggcgtacttaacgaagttaggtaaacaacaaaattagagaaacagtaaacgttccgaagggacaaggagtaccaacaagtaccgaacccaacgaaacacactacccaacgacgaccaacacgacctaacgagtaggacgaccgttagaacggtacgccgtagacgtatcgtacgacgacgacggcgttagttattagtgtggacgggtagggggttattggtgggtggcctacgtaccgagtcgtcgaccgttaaccgaacggttcggttaccgaccccggtacgggg

SEQ ID NO: 42126 - DNA, 749 bp, Homo sapiens
  misc_feature: GYAE6OF02G7VYL.36.24.C02.1.454.CMB.1.raw
  modified_base (220)..(220): a, c, t, g, unknown or other
  misc_feature (220)..(220): n is a, c, g, or t
tcagtacgctgtctcacgaccggtgctcgatttagtacagatcgttagggaaaggggacccaaaaaccacacccctccttgggagaatccctagatcacagctcctcaccatggactggacctggagcattccttttcttgggtggcagcagcaacaggtgcccactcccgaggttcagctggtgcagtctggaggtgaggtgaagagccgtggggcctnagtgaggtctcctgacaagtactttcgtaggttacagtcttttacgtaggtcttagttggtattacaacggttgggtcgaccggaacgaccggtaccccgtggaacgaaggggtcttaggaggtggaggttaggggagttaggatacgacggtcgtactttaacaaagttacggtaaaaaccgactaacgtagtacgacgaagaagtaacgtccgtacggaacggggtacaacggtacgtaccaaccgtaagtaaccgaaccgaaccgtaagaacggtaactaaccgacccgaaacggacgaccgaacgtaaccgtacctaacgtaaggtacgggtaggggttacgggaacgtcgttaagacggtaactaccggtacggtaaccggacccggtaaccgggtaccgttaccgtttaacgttacggttcggtacgacgttaggacgttaacgaaggttaactttaagttacgtaagttacggtaacgttaccgggtacgggtaaccggaacggtacccgaggttaaccccg

SEQ ID NO: 42127 - DNA, 647 bp, Homo sapiens
  misc_feature: GYAE6OF02GTF9N.36.24.C02.1.454.CMB.1.raw
  modified_base (406)..(406): a, c, t, g, unknown or other
  misc_feature (406)..(406): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagccgtggggcctcagtgaaggtctcctgcaagacttctggttacagtctttactagctatggtatcaacgtgggtgcgacacgaccccgtggacgaagggcttgaggtggagtgggatggatcagcgtcttaacaataggtaaaacactaactagtcgacacaagaacgctacgaggcagacgtcacatcgaccagaganacactaccaacgaacacacgacctaacagtaggaggttacggggacgaccgtaggagtacgtacgtacggaaccggtaccgacccgggtaccgttaccgtttaacttaaccgttcggtacggacgtaagtacgtaacgaaggttaaagttaagtttaaggttaaagttacgggtaaagttaaccgggtacgggggacccggtaaaccggggaaccccggtacgggttacccgtaaccccgg

SEQ ID NO: 42128 - DNA, 722 bp, Homo sapiens
  misc_feature: GYAE6OF02F56WV.36.24.C02.1.454.CMB.1.raw
  modified_base (291)..(291): a, c, t, g, unknown or other
  misc_feature (291)..(291): n is a, c, g, or t
  modified_base (400)..(400): a, c, t, g, unknown or other
  misc_feature (400)..(400): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtgcagcagcaacaggtgccactcccaggttcagctggtgcagtcgtgggaggtgaggtgaagagccgtaggggcctgagtgaacggtctcctgcaagtcttcgtggttacagtcttttacgagtcttagttggtactctaacgtgggtnacgtaacaccgtacccccgaggaacgaagggtcttaggaaggttcgggaagttcggggaatggtattaccggagccgtaacgtttaacaaacggttaacggtaaaaccnctaacgtatacggacaacgaagaaccgtctacgacgggcaaggacgtacgaacctagtacgaacctaacggacgtaacgaccaactacccgaacggacgaccaaccggtaaccgacccgtaagtacggtgggtaaacggggttcgggacgtaccggtagacggttatcggtacgaaaccggccctaaccggggtcctttaacgggttaaccttcggtacggttcgggacttacggtaacgtacggtaagtaaacttaagggttactaagttaaggaacggtacggtaccggggactaaccggggaacccgtggtaaccccgg

SEQ ID NO: 42129 - DNA, 668 bp, Homo sapiens
  misc_feature: GYAE6OF02FWF1F.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcgagtggaacgtctcctgcaagtacttctggttacagtctttacagctatggtatcaacgtgggtgcgacgacgtacccctaggacgaagggtcttggaggtgggagtggggatggatcgagtcgcttaacgaatacggtaaaaccacgtaactatacgactaagaacgaacgctaccggaggggctaaggacgtaccaaccgatacggaacccaagacgaacgaacactaccgaacgtacaaccgaacacgaccctaacgtaggtacgggtagggttacgggactcggtagacgtactacggtaccggacggtaccgaccgggtccgttaacgttacttaccgttgtacggacgtacggaacgttaacgaagttaagttaacgtttaagtaacggtaggtaacggttacgggtaacgggaccggtaaccggaaccgttacggtaccccgg

SEQ ID NO: 42130 - DNA, 623 bp, Homo sapiens
  misc_feature: GYAE6OF02F58I9.36.24.C02.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
tcagtacgctgtctcacgaccggtgctcgatttagtacagatcgttagggaaaggggacccaaaaaaccacacccctccttgggagaatcccctagatcacagctcctcaccatggactggacctggagcatccttttcttggtggcagcagcaacgaggtgcccactcccaggttcagctggtgcagtctggaggtgaggtgaagaagcgtgggctnagtgagtctctgcagactctgtacngtcttacagctatggtatcaagtgggtgcgacacgacccgtggacgaggtctgagtggagtgggatggatgagcgacttaacaagttaggtaaaacactaacgtatgaccaagaacgagtacctaccggagggacaaggtacgtaccaacctagtacgaacccacgtaagaacgaacctacgtaccgaacgacgaccaaacgtacgaccctaacgagttcgggtaagggttcgggacgtacgtaggactgtacgacgacgaccgccggtccgttacttacgttacgtagtacgacgtaggactaacgaaggtaacttagttaaggtaagttaggtaacgttacgggtacgggaaccgaacgggtacccgtaggtaccccg

SEQ ID NO: 42131 - DNA, 815 bp, Homo sapiens
  misc_feature: GYAE6OF02I1AU8.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccgtttttcttggtggcagcagcaacaggtgcccactcccaggttccagctggtcgcagtctgggaggtgaggtgaagaagccgtggggcctcgagtgtaacggtctccgtgacgaagactttacgtggttaacagttctttaactagtacttagtaggtatacgaaacgttggggtcgaccggaaccgaacggaacccccgttagggaaccgaaaggggtacctttaggaacgggttaggacggttagggggaacttggggaactcgaacggcgtacgtttaacaagttaacggtaaaaaccacctaagttacgtacgtaaccgaacgtaaggaaacgtcccgtaaccggaagggactaaaggtacggtaccaaacccttacgaccggaaccgaacgaacggaacgtaaaccacttaaccccgggaccgtaaagaccctaaacggaccgtaaccctaacgtaaggttacggggtaacgggttacgggggaacgttcccgtaggacgaagttcccgaacggacccggaaaccgtaccgggttaccccttagttaaacgtttaccgtcggttaacgtaccggaaggtaaccgttaacggaaagttaaacgtttagttaaggttaaggtaacggttaacgtaacggtccgggggtaaccgaacgggaaccccgtagggtaccccg

SEQ ID NO: 42132 - DNA, 807 bp, Homo sapiens
  misc_feature: GYAE6OF02F7YSH.36.24.C02.1.454.CMB.1.raw
  modified_base (221)..(221): a, c, t, g, unknown or other
  misc_feature (221)..(221): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcatccttttcttggtggcagcagcaacaggtgcccactcccaggttcagctggtgcagtctggaggtgagggtgaagaagccgtggggccctnagtgaaggttctcctgcaagtcttcgtggttacagtctttacagctagtgtatcaacgtgggtgcgacacgtaccccgtggaaccgaaggggtcctttaggacgtcggggtaattgggggtaattggacttacgacggcgtacttttaaaccgaaagttacgggttaaaaaacccaccaaaccgttagtacggtaccgaaacgaacgggaaacgtccgttaacccgagggggtaacaacgggtaacgttaccaaccccgttaaatacggaaacccaacgaacggacggaaacctacgttaaccccgacgtaacggaccctaaaccggaacgaccccttaaacgaggtttaacgggtaacggggttacggggaccgtacctagggaactacggtaacccgttaggaaccggtaaccgaaccgggttcccgttaacgttaacgttaacccgttggtacgggtacccggtaggaacgtaaaccggtaggtaaaacgttttacgttaaggttaaaacgttagggttaacctaacggggtttaccggggggaaccccgtaaccgggggttaaaccgaaccgggttaacccg

SEQ ID NO: 42133 - DNA, 654 bp, Homo sapiens
  misc_feature: GYAE6OF02HQWYM.36.24.C02.1.454.CMB.1.raw
  modified_base (345)..(345): a, c, t, g, unknown or other
  misc_feature (345)..(345): n is a, c, g, or t
  modified_base (457)..(457): a, c, t, g, unknown or other
  misc_feature (457)..(457): n is a, c, g, or t
  modified_base (514)..(514): a, c, t, g, unknown or other
  misc_feature (514)..(514): n is a, c, g, or t
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtcgcccactcccaggttcagctggtgcagtctggagtgaggtgaagacgccgtgggcctgagtgaaggtctctgcaagtcttgtcggttacagtctttactgtcttagtggtactcgtaacgtgggtgacgtacaccgtaccccgtggaccgaagggtcttaggaggtggagtgggtatggatcgngtcgtactaacaagtaacggtaaaacactactagtcgacaacgtaacggaacgtccgtaaccggacgggactaaaggaccgtacacctagtaccgaaccacgaagacacacnccgaacgacgcaacacgacctagtacggtagggtcgggtagggactccgagtacgtntccgtaagaccgtaccgacggtccttattacgttcgtagtcgacggtagtacgtaagtaacggtaacttagttaaggtaacgtggtaaacgttacggggtaccgggaaccgtaacgggtacccggtccggttaaccccgg

SEQ ID NO: 42134 - DNA, 800 bp, Homo sapiens
  misc_feature: GYAE6OF02JNYLX.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagctggtgcagtctggaggtgaggtgaagagccgtgggcctcgagtagaggtctctgacaagtacttcgtcggttacacgtctttactagtctagtaggtatactaacggtcgggttagacgtaacgaccgtaccccgtaggaaccggtacgggtcgtttaggaacgggttgggtaaggttggggaacgttagggactcggtacggtccgtaacttaacgtaaacgttaacgggtaaaaaccacgtaacgttacgtacggaccgtaaacgaaggaaccggtaccgttacccggacggggaacgtaacggtaaccgtacccgaaccgttaacggtaccgtaaacccgaacggaacgggaaccgtaacccgtaacgtaaccccggaacgaaaccggaccgtaacccgtacggaaccctttagaaccgggttaggggttaaccggggttacggggacctttacggaaggtaccggtacgttacggtacggaaccggaccgtaaccgggttaccgtaccgtttaagttacggtcggtacgtagtaacgacgttaaggaacttaagttaagttaggtaacgaggttaacgttacggaccggtacgggaaaccgtccgggtagtacccgg

SEQ ID NO: 42135 - DNA, 741 bp, Homo sapiens
  misc_feature: GYAE6OF02HNG6V.36.24.C02.1.454.CMB.1.raw
tcagtacgctgtctcacgaccggtgctcgatttagtacagatcgttagggaaaggggacccaaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagccgtggggcctcgagtgaaggtctcctgcaagcttcgtggttacagtctttactagctatggtatcaacgtgggtgacgacgacgacccctggacgaagggtcttgaggtggagtcgggatcggtatcgaggctactaacgaaagttaggtaaaaccacgtaacttagtacgacctaagaaggtaaccgtcctaccggaaggggtaccaacgggtaaccgttaccgaacccgtaacgttaaccggaaccccgaaacgtaagggtaaacccgaacgtaaccgttaacccgaacggtaaccgaccaaacgtaaccgtacccgtaacgtaacggttcgggggttaaggggtttacggggaaccggtccgttaaggacggtacttacggaaccggaacggacccgtacgggtacccttaacggtttacttacggcggttaacgcggtaagtaacgttaacgtaagtaactttagttagaaacggttagtaaccgttacgggtaccgggaccggaacgggtaccccgtaagtaccccg

SEQ ID NO: 42136 - DNA, 732 bp, Homo sapiens
  misc_feature: GYAE6OF02F3SXI.36.24.C02.1.454.CMB.1.raw
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
tcagtacgctgtctcacgaccggtgctcgatttagtacagatcgttagggaaaggggacccgaaaaaccacacccctccttgggagaatcccctagatcacagctcctcaccatggactggacctggagcattccttttcttggtggcagcagcaacaggtgcccactcccaggttccagctggtgcagtctggaggtgaggtgaagaagccgtggggcctnagtgaggtctcctgcaagcttcgtggtacngtctttacngcttagtgtatcagtggtagcgacgacgacccctggaacaggtctgagtggatggganggntcgagtcgacttacgaagttaacggtaaaacactactagtacgacaagaaggaccgtccgtaccggaggggaccaggtacctaccgaaccgtataccgaaccgacgaagacgaacctacgtacccgaacgaaacctaaccgtaaccggtaccttaacgaacggtagggtaacgggttacgggggtaaccgtaccgtagggtaacgtacgttaccgtagggtaacccggaccggttacccgggtacccgttacgttaaaggtttaccgtggttaacggacggttaacggttacggtaactaacggtaactttaacggttaagttaaccggtaaggttaaccggttaacgggtccgggggtaaaccccggtaacccgggaaacccgttaccgggtacccttaaccccccggg

SEQ ID NO: 42137 - DNA, 860 bp, Homo sapiens
  misc_feature: GYAE6OF02IKPJ5.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacaggtgcccactcccaggttcagcgtggtgcgtagtcgtgggaggtgaggtagaagaagccgtggggcctcgaggtgtaaggtcctctgacagtacttcgtacggtactagtacctttatagtctagttaggtacttacgtacggtgggtgacgacgtaccgtacccgttaggaacgtacgggtcgttaggaggtacggagtaggggagtggtacgtcgaggtccgtacgttaagaacgttaacggtaaacaccgtactagtacgaactaacgaacggaacgtccgtacgggacgggtacaacggtacgtaacccgaaccgtacggtaaccgaaccgtaacggaacggtaaccggtaacctacccggaaaccccgaaacgggtccggaaaccctaacccggtaacccgtaacccggtttaaacgaacgggggtttaggtaacccgggggttacgggggtaaccttaccggtaacggggtacgttaacgttacccggaaaccgggtacccggtaaacccgggtaccggggttacccgttaaaccgttttaacggtttccgaacggggttacctaccggtaacggtttaaacgtaacggtaacgttaaaagttttcgggtttaaggaaccgttaagggttaaccgttaacggggtaaccccggggaaccggttaaacccggggaccccgtagggtttaaccccccgg

SEQ ID NO: 42138 - DNA, 699 bp, Homo sapiens
  misc_feature: GYAE6OF02GYQQP.36.24.C02.1.454.CMB.1.raw
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
tcagtacgctgtctcacgaccggtgctcgatttagtacagatcgttagggaaaggggacccaaaaaaccacacccctccttgggagaatcccctagatcacagctcctcaccatggactggacctggagcatccttttcttggtggcagcagcaacaggtgcccactcccaggttcagctggtncagtctggnggtgaggtgaagacgccgtggggcctcgagtggaacggtctccngacaagcttcgtggttacagtctttactagcttagtggtatcaacgtgggtcacgacacgaccccgtggacgtacgggcttggaggtggagtgggagtcggatcgaggctacttaacgaagtaacgtaaaaccacaacttacgcgacaacgaagacgtcgtaccggagggacaaggtacgtacccaacgtacgtaaccggaccaacggaacggaacgtaacccacgtaccccgaacgggaaccgacccgaacgtaaccgtacctaccgtaagggttacgggtaacggggttacgggaaccgtaccgtaggaagtacgtcggtacggacccgtaaccggaccggttcctttaacgttacttacggtgtccgaggtacgtaacggtacgaagttaacttagttaaggtaacgttagggtaactacggggtccggaaccggtaacggtacccggtaggtaccccg

SEQ ID NO: 42139 - DNA, 787 bp, Homo sapiens
  misc_feature: GYAE6OF02GN6DM.36.24.C02.1.454.CMB.1.raw
  modified_base (283)..(283): a, c, t, g, unknown or other
  misc_feature (283)..(283): n is a, c, g, or t
tcagtacgctgtctcacgaccggtgctcgatttagtacagatcgttagggaaagggggacccaaaaaaccacacccctccttgggagaatcccctagatcacagctcctcaccagtggactgggacctggagcatccttttcttggtggtcagcaggcaaacgaggtcgaccccactcccgaggttaccagctggtgcaggtctgggaggtgaggtgaagaagccgtggggcctgagtggaacggttctccgtgacagtacttcgtggttacagtctttaagngtactagtggtatctaagtgggtcgacgacgacgtaccccgtggaacggaagggtcttagggaacggttagggtagtacgggtacgtggactacgacggtccgtacttaacgaacgttacggaaacctaactaaaacgttacgtaggaaacgtacggtaacggtacgaacggggacaacgggaactaccgaaaccgtagttaccggaaaccaaaccgtaaacgacgaacgtacccgaaaggaacctacaaaccggtacgaacctaacggtaggtacgggacgtaggacgggtaacggacggtaccgtaaggtacggcgttaccgaacggtaaccggtaccgggtccgggtacgttaagttattacgggtggtaaggggtacggggggttacggggggttttacggggtgggttacgggaccgttaacgaccggtagtccggttaacggacccgtttaaaccggtaaccgggttccgggttacccgggtcccgggtaacccgggg

SEQ ID NO: 42140 - DNA, 1005 bp, Homo sapiens
  misc_feature: GYAE6OF02F8YOT.36.24.C02.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacagatcgttagggaaaggggacccaaaaaaccacacccctccttgggagaaacctccccgtagataccaacgagccttccctacaaccctagtacggacgtcggaccgtaggacgctacttttcccttttcgttgggtcgacgacgcgacgacgaacgtacggtccgaccctacccgtacccgtacggttacncggtccgtgggtcgcgtacggttcggtcgggtaggtggtagggtaacggaaggaaccggtccgggtaccggggtcctaacggtaggttacgggtaacgttcccgtaccgtaggaacgtaaaccgttccgttttaccggtacgggtttaacgtccgttaaccgttttaacggtacgttaacgttaacggttacggtttaacgtaccgttacggggttacggggtaccggaacccgtaacgtaacccccggtaacccgggttaaaggaaaccggggtaacgggtttcggttaacggggtaacgggttaagggtacgggttacgggttaacgggttaccgtaacggtaccggtaccgggtttaccgtaaacgtttaaccggtaaaacggttaaacggttaaaacctaccgtacgtttacgacgtaaaccgaacgtaacgtaaccggtacccggtcggaaggtaaccgacgttaaccgtaccgtaccgtaacgtacccgaaaccggtacggaactaaccggaacccgtaaccgtaaccggaaacccgacgtaccgtaacccgtaccggtaacccgtaaggtacggggttaacgggtaacggttaacccgggtacgtaaccgaggttacgtacgtccggaaccgtacggacccgtttacggtacccttaagttccgtcgaaggtcgtaaccggtatacggaattacggtaatttacgtaaggttaacgagtaacggttacgggacccggttaacggacccggtacggtacttacccccgg

SEQ ID NO: 42141 - DNA, 807 bp, Homo sapiens
  misc_feature: GYAE6OF02G84X4.36.24.C02.1.454.CMB.1.raw
tcagtacgctgtctcacgaccggtgctcgatttagtacagatcgttagggaaaggggacccaaaaaccacacccctccttgggagaatcccctagatcacagctcctcaccatggactggacctggagcattccttttcttggtggcagcagcaacgaggtgcccactcccaggttcagcgtggtgcagtcgtggaggtggaggtgaagacgcgtgggcctgagtagaacggtctcctgacaagtacttcgtaggttacagttctttacagcttagtgtatactaagttggtcgacgtaacgacgtaccccgtaggaacgagggtcttaggaggtggacggtgggtatcggtatcgtaggtcgtacttaacgaacgtaacggtaaaacaccgtaatacgtagaaccaacgaagaaccgaccggtaccgacgggtacaagtaccgaactaccgaacgtacgaacccaacggagtaaaccaaccgtaccgacccgaacgaccgacaaccgaacccgttaccgtacgtaacggtacggggtaacggtttcggggaccgttaaccggtacggaacgtacgttacggtaaacccgggtacggtaacccggtaacccggttaccgtttaaccgtttagtttaaccccggtgggtacggttaaccggaaaccggttcggttaaaacggaaaggttaaagttttaaccggttaaacgtttaagggtaaaggttaaacccgggttaacggggttaaaccccggggaaccccggggtttaaacccggggaaccccgtaaccggggttaaacccccgg

SEQ ID NO: 42142 - DNA, 502 bp, Homo sapiens
  misc_feature: GYAE6OF01DAHZQ.52.75.G09.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (328)..(328): a, c, t, g, unknown or other
  misc_feature (328)..(328): n is a, c, g, or t
  modified_base (489)..(489): a, c, t, g, unknown or other
  misc_feature (489)..(489): n is a, c, g, or t
tcagcgcagtacgacacgaccggtgctcgatttagtatagacatcaacgacacaaaagggggcaggagtcagtcccaaccaggacacagcatggacatgagggtccctgctcagctcctgggctctgctgctctggctcgtcaggtgccagatgtgtcatccagatgacccagtctccatcctccctgtctgcatctatagganacagaatcaccatcacttgccggngagtcgagacattagacatgtatctgaattggtatcagacaaaaaccagggacacgcccctaaactcctgactcctcgaatgcatccaactttggaaacnggggtcccaatcaaggttcagtcggaagtggctcgtggggactagtattttacttcacctatcagcaggctgcagcctagaagacattgacaatattattactgtacaacagtatgatgtctcccgctactacgttcggggaccgggggacagggtgaagntacgagcgtaacg

SEQ ID NO: 42143 - DNA, 544 bp, Homo sapiens
  misc_feature: GYAE6OF01CJU40.52.75.G09.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctccgtggacagtcgatcaccatcctctgcactggaaccagcagtgacattggtcttaataactatgtctcctggtaccgacaacacccgganaaacgccccaaaatcatgatttangctgtctattacncggcccgnagggtatttcncatcgctttcnctggactccaagtctggcaacacggtcctccctcaccatctctgggctcctgctgagacgaggctgatttattactgcagctataattacaaacgtccaacccacactactagttaactcgtccgggcggacgggaaccctagcctacgtacccgtaccgtaaggttccaacgacccaacggtcccgtcgtacccccg

SEQ ID NO: 42144 - DNA, 525 bp, Homo sapiens
  misc_feature: GYAE6OF01BIWIL.52.75.G09.1.454.CMB.1.raw
  modified_base (223)..(223): a, c, t, g, unknown or other
  misc_feature (223)..(223): n is a, c, g, or t
  modified_base (420)..(420): a, c, t, g, unknown or other
  misc_feature (420)..(420): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctcgtgtctgggtctcctggacagtcgatcaccatctcctgcactggaaccngcagtgacattggtcttataactatgtctctgtaccgacaacacccggcaaacgcccccaaactcactgatttatgctgtcacttatccggtcccgcagggtatttctcatcgcttctctggctccaagtctggcaacgacggcctccctcaccatctcgtggcctctgactgacggacgagtctagtattattacngcagtctactattacagcaccacacctctataactcgtacggacggtacggaccaagctacgaccgttaccgacggttcacgacccgaacgccgtccgtaccccg

SEQ ID NO: 42145 - DNA, 752 bp, Homo sapiens
  misc_feature: GYAE6OF01ACP9I.52.75.G09.1.454.CMB.1.raw
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
tcagcgcagtacgacacgaccggtgctcgatttagtatagacatcaacacacgaaagggggcaggagtcagtcccaaccaggacacagcatggacatggacgggtccctgctcagctccgtgggctcctgctgctcgtgctcgtcgaggtcgcagtagtggtcgtacactccagtactccgaacccgtctcctcctacttccccgtccttgtctagactatacgtaaggagaacgacactacaccactactcgtacggtcggccgggtagacgtacgagtactagttagctaagttgtactgttaagtagtgtaacacgaaacgaacgaacgcgaactccgacctanctagtactctacgnacactactacgtaacgtaacggacgtacgacctagtaacgtggtagaggtaggtacgtcgggacttacgggtacgtaactttaccggttttacctttaccgaacgaccgtactaacgggcggttaccgacggtccgtaaccggactaaaccgggttcaaacggtacggtttaaaacctcgttaaacgaaccctttaaagttaccggtttaaactttacccggaaaggttaacccgtaagttaacggttaccgggttaaactccctttaacccggggtccccgtttacccgggttaaaccgggtttacggggggttaacggggacccggggggtaaaccggttaaagtaggggtacaaccggttaacggaacgggttcccgtttagggcggg

SEQ ID NO: 42146 - DNA, 519 bp, Homo sapiens
  misc_feature: GYAE6OF01EMIYP.52.75.G09.1.454.CMB.1.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagcgcagtacgacacgaccggtgctcgatttagtatagacatcaacacataaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaacngggacagccctaaactcctgactcctcgatgcatccactttggaaacaggggtcccatacgaaggttcagtggaagtggctgtgggacagtattttacttcacctatcagcaggctgcagcctagaanacattgacaanatattactnttacaacagtatgaatcgtctcccgcttagaccgttttccgggggacggggggtaacccaggggttacggaagtagtacgaaaggacggtaaaccgg

SEQ ID NO: 42147 - DNA, 544 bp, Homo sapiens
  misc_feature: GYAE6OF01D4IMV.52.75.G09.1.454.CMB.1.raw
  modified_base (223)..(223): a, c, t, g, unknown or other
  misc_feature (223)..(223): n is a, c, g, or t
  modified_base (408)..(408): a, c, t, g, unknown or other
  misc_feature (408)..(408): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctcgtgtctgggtctcctggacagtcgatcaccatctcctgcactggaaccngcagtgacattgggtcttaataactatgtctcctggtaccgacaacaccccggcaaaagccccccaaatcatgatttatgctgtcacttatcggcccgcagggtatttctcatcgcttctctggctccaagtctggcaacacgccctccctcaccatctcgtcggctcctgactgacggacgagntgtatttattaactgcagctacgtatttaacaacgtccaaccaccctactccttagtaaactccgttcgggacggacgggtaccaagcgtcgacccgtcctacggtaccacggacccaacggcctccggtcccccg

SEQ ID NO: 42148 - DNA, 618 bp, Homo sapiens
  misc_feature: GYAE6OF01DV4R1.52.75.G09.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
  modified_base (440)..(440): a, c, t, g, unknown or other
  misc_feature (440)..(440): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactcgtgggcacaggactcccggccagtctcgccctgactcagcctcgcctcgtgtctggtctcgtggacngtcgatcactntcctctgcagtcggaaccngcagtgactagtttggtacttaataacttntcgtctccgtggtaaccgaccaaccgaccccggactaaaaccgcccccaaaatccgtatcgtatttatcgcttcgactacttacgtcccggacccgngtaagggtctttccgtactacttccgtcttactcgtacggtcctacgacgtcgtcggacaaccgacgtccctccacacctctcttcgnggtcctccgtgtaacgtgacggacgaggtcttagtattaactcgtcgatcgtactctaacttacaacgttaccaccactacctactacgttagtccgttacggacggtaacggtcaacggtcttaacggtccgtacgttaccggcgtaccgaccgtaacggtcctcccggtaccccgg

SEQ ID NO: 42149 - DNA, 582 bp, Homo sapiens
  misc_feature: GYAE6OF01BY6OG.52.75.G09.1.454.CMB.1.raw
tcagcgcagtacgacacgaccggtgctcgatttagtatagacatcagggggctggggtctcaggaggcagcgctctcgggacgtctccaccatggcctgggctctgctattcctcaccctctcactctgggcacaggactcccgggccagtctgccctgactcagcctgcctcgtgtctgggtctcctggacagtcgatcaccatctcctgcactggaaccagcagtgacattggtacttaataactatgtctcctggtaccgacaacaccccggcaaacgcccccaaaactcatgtaatttatgctgtctacttactcggcccgcagggtatttcgtcatcgtcttctctggctccaagtctggacaacgacggccctccctcacctatcctcgtcgggactcctgactggacggacgtaggcctaggtatttacttactgcagtctctaatttacaacgtaccaccaacccacttactacgttaacttccgttaccgggcgggtaacgggacctaagccgtacggtacccgttaccgtaggtacccacggaccccgaaggcccgtaccggttccccccgg

SEQ ID NO: 42150 - DNA, 632 bp, Homo sapiens
  misc_feature: GYAE6OF01BX15Q.52.75.G09.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacngtcgatcaccatctcctgcactggaaccngcagtgacattggtcgttataactatgtctcctggtaccgacaacaccccggacaaacgcccccaaactcatgtatttatgctgtctacttacgtccggcccgcgagggtactttctcacttcgtcttcttacgtcggtcctcccgtaagttctacggtaccaaccgaccggtcccctacccctcaaccctacttcctccgtcgggtcctccgtcgaactcggaaggaccggaggtcttaggtactttattacgtgcgtagtctcttaactttaccgaacgtacccaaccctaccctacgttaccttacgttaaccttccgttacgggccgggtacggaacccgtagaccgtcgtacccgttccgtacggtaccgacggaccctaacggccgtcccggtaccccccgg

SEQ ID NO: 42151 - DNA, 583 bp, Homo sapiens
  misc_feature: GYAE6OF01A2U75.52.75.G09.1.454.CMB.1.raw
  modified_base (228)..(228): a, c, t, g, unknown or other
  misc_feature (228)..(228): n is a, c, g, or t
  modified_base (331)..(331): a, c, t, g, unknown or other
  misc_feature (331)..(331): n is a, c, g, or t
tcagcgcagtacgacacgaccggtgctcgatttagtatagacatcaacacacgaaagggggcaggagtcagtcccaaccaggacacagcatggacatgagggtccctgctcagctcctggggctcctgctgctctggctctcaggtgccagatgtgtcatccagatgacccagtctccatcctcctgtctgcaatctataggagacagaatcaccatcacttgccggnagtcgagacattagcatgtatctgaattggtatcgaagacaaaaaccgagggaccacgaccccgtaaactcctgactcctacgatgcatccatttaggaaacngggtacccatcaaggttcagtggaagtggcctcggacgtagtactttactttctacctactacacgacgacgacgtcgacgacgccgtagaacggaacgacttagacaactaacttacttactagtacgaactagtaatagtagttacgttacctcccgtaccgtacctaccgggtttaccggggaccgggggtaacccggaacggttacgggtaacggtaagtaccgaacggtaccggtaacgttacgggg

SEQ ID NO: 42152 - DNA, 755 bp, Homo sapiens
  misc_feature: GYAE6OF01COACW.52.75.G09.1.454.CMB.1.raw
tcagcgcagtacgacacgaccggtgctcgatttagtatagacatcaaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttggccgggcgagtcgagacattagcatgtatctagtaattggtatcgaagaccaaaaaccgagggtaaccacgacccctaaaactcctagtactccgtacgatcgcctactcctaacgtttacggaaaccgacggggtaccccaagttacgaaacggtttcgaagggttagggaaacggttcgggtaccgttacgggtacggggtaacgtaacggtttaacttttttaaccgtttaccaaacccgttagttaccgaacggtaccgtacgggtccttacggacccgtaacggtaccgttaacgggaaaacggtacccttaaagttttcggaaactaaaaccttaacgtttaaacgttttaacttacggttaaacctaaaccggttaagttaacgttaggtaaacgtttaaccggtttcccgttacccccgtaccgtttcccggttaacccggggttttaccggggggacccgggggggtaaaccgtaacgggggtacggtaaacggtacgtaaacggaacgggtaccgtaaacggg

SEQ ID NO: 42153 - DNA, 713 bp, Homo sapiens
  misc_feature: GYAE6OF01D24CF.52.75.G09.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagcgcagtacgacacgaccggtgctcgatttagtatagacatcagggggctgggggtctcaggaggcagcgctctcgggacgtctccaccatggcctgggctctgctattcctcaccctcctcactcgtgggcacaggatcccgggccagtctgccctgactcagcctgcctcgtgtctgggtctccgtggacagtcgatcaccatctcctgcactggaaccngcagtnactagttggtcttaataactatgtctcctggtaccgacaacacccggcaaacgacccccaaactcatagtatttatgtctgtctacttacgtccggcccgcgtagggtacttttctcgtactccggtctttcctcgtcggtacctacctaagtccgtggaccgtaaaccgcccggtaccctcccgtaccaccgtacttccgttccgttcgggtcccttccgttacggtaccgttaggaacgggaccgtacgggtcttacgttaattttacttacgtcgtacgtacgtcttactaacgtttaacgaaccgacctaaccctaacccgtaccttccgttaacgttaaccttccggtttaccgggggaaccgggtaaccgggaaacccgttaaggacccgtttaccgggtaacccgttcccggttaaaccggtaccgtaacccggaaccccggaacggttccccgtccccggttaccccccccggg

SEQ ID NO: 42154 - DNA, 692 bp, Homo sapiens
  misc_feature: GYAE6OF01CIO62.52.75.G09.1.454.CMB.1.raw
  modified_base (114)..(114): a, c, t, g, unknown or other
  misc_feature (114)..(114): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
tcagcgcagtacgacacgaccggtgctcgatttagtatagacatcagggggctggggtctcaggaggcagcgctctcgggacgtctccaccatggcctgggctctgctattccncaccctctcactcgtcgggcacaggactcccgggccagtcctcgccctgactcacgcctgcctcgtgtcgtggtctcgnggacngtcgactccacctatcctcgtcgcacgtcggaaccngtcagtcactagttcgggtacttaataactagtcgtcctcgtacggtaccgaacaaccgacccggaccaaaccgacccctaactctacgtacgtatttactcgtctcgtactacgttacggccgtccgacgtacggttactttacctctacgttctccttcgtacgtcgtacctacgtacgtcgtacggacctaaccgtccgtccctccctaccacctacgtccgtcgttccggtaccttccgtaggtaccggtacggacggacgtacggtacgttagtactttacgtcgtcgtactcgtacttactaacttacgaaccgtacctaacctacctaccgttaccgttaacgttaccggttccggtaccgggaaccgggtaccggaccgtacggtaccgttaccggccgttacgtaccgtaccggacgaacccggtaccggtcccgttcccggtaccccg

SEQ ID NO: 42155 - DNA, 731 bp, Homo sapiens
  misc_feature: GYAE6OF01EHYXP.52.75.G09.1.454.CMB.1.raw
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
tcagcgcagtacgacacgaccggtgctcgatttagtatagacatcaacgacacaaagggggcaggagtcagtcccaaccaggacacagcatggacatgagggtccctgctcagctcctggggctcctgctggctcgtggctctcaggtgccagatgtgtcatccagatcgacccagtctccatccctccctgtctgcatctaagtaggagacagaactccacctatctacgttcggccgggtgacgtcgagactattacgctatgtatctacgtaattggtanacaagaacaaaacgnggacacgtacccctaaactcctagacttccgacgtagtcgacctaacttaccctaagtttaacgggaaacgtaccggggtaccctaaggttaaccgttaaggtacgtaacgggtagggtaaccggttcggtaccttccggtaggggtaaccttaggttttacctttttaaccgttacctaaccgtacttacgaacggtcgtaacgggtcctacggtaccaccggttacgtaacggaaacgttaactagttacggaacctaactaagtttaacttacgtacgtacgtaactagggttaacgttagtaaccgttaccgtcccgttaaccccgtcgtttaccccgggtttaacgggttccccggggggaacccgggggtaaacgtaacgggggtacgtaaacggtacgttaacccgaaacgggtacgttaaccggg

SEQ ID NO: 42156 - DNA, 782 bp, Homo sapiens
  misc_feature: GYAE6OF01EHD10.52.75.G09.1.454.CMB.1.raw
  modified_base (115)..(115): a, c, t, g, unknown or other
  misc_feature (115)..(115): n is a, c, g, or t
  modified_base (264)..(264): a, c, t, g, unknown or other
  misc_feature (264)..(264): n is a, c, g, or t
  modified_base (417)..(417): a, c, t, g, unknown or other
  misc_feature (417)..(417): n is a, c, g, or t
  modified_base (613)..(613): a, c, t, g, unknown or other
  misc_feature (613)..(613): n is a, c, g, or t
  modified_base (621)..(621): a, c, t, g, unknown or other
  misc_feature (621)..(621): n is a, c, g, or t
tcagcgcagtacgacacgaccggtgctcgatttagtatagacatcagggggctggggtctcaggaggcagcgctctcgggacgtctccaccatcggcctgggctctgctattccncaccctctcactcgtcgggcacgacggactccccgggcctagtctcgccctgacctcacgcctcgcccgttcgtgtccgtgggtcctccgtggactacggttcgacttaccgaacctattcctaccgtgacctacggtacggaaacccnggaccgtaaggtcgtaaccgttagttttccggggtaactttaactaaaaccgttgttacggttcctaccggttaacgggaaacccgaaaccaaacccggacccccgggtaacaaaaccccggaccccctaaagtctaagttgtaacttttacncgtcgttacgtaccttacgttccggcccgggtccaggtacggtttactttcgactacgtccgttcttctacggtcgtcctacgtaagttcgagaccaaccggtccgccctacctacctacgtcttcggtacggcgtaccttcgacggacgtaggacgggtaccaggtcttaagttaacttttagcgtacgaccgtntaaccgtnttaaactaacccgacgttacccaacccttaccgtacgtttacctaacggttaccgtcgggtaccggaaccgggtaccgggaacttacgcggttaacccggaccgttccgggtaaccgtccggaaaccggtacccgaaccgtcccgtcccgggttacccccg

SEQ ID NO: 42157 - DNA, 708 bp, Homo sapiens
  misc_feature: GYAE6OF01BG6DQ.52.75.G09.1.454.CMB.1.raw
  modified_base (242)..(242): a, c, t, g, unknown or other
  misc_feature (242)..(242): n is a, c, g, or t
  modified_base (574)..(574): a, c, t, g, unknown or other
  misc_feature (574)..(574): n is a, c, g, or t
tcagcgcagtacgacacgaccggtgctcgatttagtatagacatcaacgacacgaaagggggcaggagtcagtccaaccaggacacagcatggacatgaggtcctgctcagctcctgggctcctgctgctcgtggctctcaggtgccagatgtgtcatccagatcgaccagtctccatccctaccttggtcctgtactatctagtacggagacagactccactatcacgttcggccgggtanacgtacgaagtacgtattagacgtatgtacgttacgtagtaagttggtactacaacgtaaccgaaaacgtcgggaactaccggtaaccccttaaacgtcctagaccgttactacggtacttagtacctactaacccgttacgttaacgggtaaaccggtaccgggtacctaaacgtaccgtaaacgggtttcgaacgggtacggtaagttcggacgttcgggaaccgggtaatttacggttaacttttacgtacctacgacgttacgacgtcgtagcgtgtccgtagtacgtagaagtacctagttacgaactaacgactttactaaccgtntaaccgtaatcggtttaacgagttacgttaccgacccgttttacccgacgttacccggttaacgggtttcccgggggaccgggtaacgttaaacggggtcgaaaacggtactaccgtaaagggtccggtaacgg

SEQ ID NO: 42158 - DNA, 683 bp, Homo sapiens
  misc_feature: GYAE6OF01D4DG0.52.75.G09.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (212)..(212): a, c, t, g, unknown or other
  misc_feature (212)..(212): n is a, c, g, or t
  modified_base (286)..(286): a, c, t, g, unknown or other
  misc_feature (286)..(286): n is a, c, g, or t
  modified_base (496)..(496): a, c, t, g, unknown or other
  misc_feature (496)..(496): n is a, c, g, or t
tcagcgcagtacgacacgaccggtgctcgatttagtatagacatcaacgacgacgaaagggggcaggacgtcgagtcccaaccgaggacgacagcatggacatgaggtccctgctacagctccgtgggctacctgctgcgtctggctcttcaggtgccagatgtgtcatccagatgaccngtcnccatcctcctgtctgctatctatagganacagactcacatcattcgcggcagtcgagcattcgctatgtatctagtaattggtatcgacgaaccaaaaacgngggaaccacggtaccctaaacgtcccgtaggtaacttccgtacggtattacgtacctaacgttacctaacgtttaacgggaaaaccgttcggggtaacccagttaaccgaacggtttacgagggtacggtaacggtacgtcgtaacggtacgggtaactaacgttttacttttaaccttctaaaccctagtacgaacgtacgtaacggtntttacggacctaacgtaaccgttagaaacttacccggtattacgaaaccggtaacttaactttaacgtacgtacgttaacctaagtagtttactaagtacgttacgtccgtaccgtcgtaccggttacggttccgggggaacgggtaccgtaagggtcgtaaagtacgtaccgaaggtggtaaccgg

SEQ ID NO: 42159 - DNA, 673 bp, Homo sapiens
  misc_feature: GYAE6OF01COWC2.52.75.G09.1.454.CMB.1.raw
  modified_base (122)..(122): a, c, t, g, unknown or other
  misc_feature (122)..(122): n is a, c, g, or t
  modified_base (157)..(157): a, c, t, g, unknown or other
  misc_feature (157)..(157): n is a, c, g, or t
  modified_base (603)..(603): a, c, t, g, unknown or other
  misc_feature (603)..(603): n is a, c, g, or t
  modified_base (622)..(622): a, c, t, g, unknown or other
  misc_feature (622)..(622): n is a, c, g, or t
  modified_base (659)..(659): a, c, t, g, unknown or other
  misc_feature (659)..(659): n is a, c, g, or t
  modified_base (666)..(666): a, c, t, g, unknown or other
  misc_feature (666)..(666): n is a, c, g, or t
tcagcgcagtacgacacgaccggtgctcgatttagtatagacatcaacgacacaaaggggggcagggagtcagtcccaaccaggacacagcgatggacatgtagggtccctgctcagctcgngggctccgtgctgcctgtggcttcgacgagggtcnccgatatgtgtcatcgagtactccgacctagttcctcctctccctcctgtcctaggactattcgaagtaggaacaacgtaacgaactaccacctatacccgtacggttccgggaccgggtagtaccgtacggaacgtaactagttacgacttagtagttaatacgtaggttaagttaggtactacgaaccgaaaacctaaacggacgggaacctaacccgacccctaaatccgtagtaccttccgacggactcgtactaccgtacgttacggtaacggaaccggtccggacctaagttaccgaggttacagggttagacgtcgtctacgggtagtaccttaagttttcctttaccgaccccagtccgtacgtacgacgtacggctcgaccgtacgtcggaagtaactacgtatacggactaagttcttaactgtacgtaacaagtntactggacttccgtctacncggttgtacggggtgggaccgtacgaggtacgactanaaacggnggcctag

SEQ ID NO: 42160 - DNA, 763 bp, Homo sapiens
  misc_feature: GYAE6OF01A2PQL.52.75.G09.1.454.CMB.1.raw
  modified_base (278)..(278): a, c, t, g, unknown or other
  misc_feature (278)..(278): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcgttaataactatgtctcctggtaccgacaacaccccggnaaacgcccccaaactcatgattatgctgtcactttatcggcccgcgagggtatttccgtctatccgctttccgtctcggtcttaccaaggttcctgggtaccaaaccgaccggtccccttcccccgtacctaaccctaacttccgtcccgttcggggaccccgttccctacggtaccgttacggaacggggtaccggacgggttccgttacggtaacttttaacgtttaaccgtcggtaccgtacggtaccttaccgttaacgttttaaccaaaccggttaacccaacccctaacccccgtaacccttaccccgttaacggtttaaacccgttaccggtttacccggggtaccggggtaaaccgggggaacccccgtaaaggtacccccgttacgggtaaccccccggttaacccggttaccgggtaacccgtaaccgggtaaccccccgaacggggtcccgttcccccggtaaccccccccggg

SEQ ID NO: 42161 - DNA, 780 bp, Homo sapiens
  misc_feature: GYAE6OF01A1G2K.52.75.G09.1.454.CMB.1.raw
  modified_base (209)..(209): a, c, t, g, unknown or other
  misc_feature (209)..(209): n is a, c, g, or t
tcagcgcagtacgacacgaccggtgctcgatttagtatagacatcaacgacgacaaagggggcaggagtcagtcccaaccaggacacagcatggacatgagggtccctgctcagctcctggggctcctgctgctctggctctcaggtgccagatgtgtcatccagatcgacccagtctccatcctccctgtctgcattctagtaggganacagaatcaccatcacgttgccgggtgagtcgagacattagctatgtatctgattggatcagacaaaacgaggacacgaccctaactcctagacttccgtcgtatacgacctataccctacgtttaacgggaaaccgtacggggtacccacgttaccgtaaaggttacgaacgggttacgggtaacggttacgggtaccgttccggtagggggtaacctaacggttttaacctttttaacccgtttacaaaccccgttaattaccggtaacggtaccgtaagggcccgtttacggaaccgtaccgtacccgtaggtaaaaccggttacctaacgtttaccggaacctaaactaactttaaacggtttaaccttaacggtaaccttaaaccggtaagtttaacgtacggtaacgttaccggttaccccgtttaccccggtaccttttaaccgggtacccggggtttttacccggggggaacccgggggggttaaacccgggttaaacgggggtaccgggttaaacgggtaacggttaaccccggtaaaacgggtcccgggttaaacccgggg

SEQ ID NO: 42162 - DNA, 816 bp, Homo sapiens
  misc_feature: GYAE6OF01DUKUG.52.75.G09.1.454.CMB.1.raw
  modified_base (137)..(137): a, c, t, g, unknown or other
  misc_feature (137)..(137): n is a, c, g, or t
  modified_base (152)..(152): a, c, t, g, unknown or other
  misc_feature (152)..(152): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagcgcagtacgacacgaccggtgctcgatttagtatagacatcaacacacgaaagggggcaggagtcagtcccaaccaggacacagcatggacatggagggtccctgctcagcctccgtggggctcctgctgctntggctctcgaggtcncagtgtgtgtcactccagtactccgaccctagttccctcctaccttcccctccgttgtctcgactatacgtagtacgganacgaanaacctaccacgtactacgtacggttcgggaccgggtagtacggtacggacgtacgtaattagacgttagttcgtactacgtaagtttaacgttaggactaacggaaaccgaaaaccgaaacggacggtaacctacccgtaacccttaactccgtagtaccgttccgacgtacgtacgtactaccgttaacgtttaacggtaaacggaacccggtaccgtacgtaacgttacgggacgttaaggacggttaggtacggcggttactaagggtacgtaactttactttaaccgttttacgaacctacgtagtccggaacggttcgacgtacgacgcctacggtacgtaactacgtacgttacgtaacgtaacttaacgttaagtttccgtaaactaccggtaacttaagggttactaaacgttcccgggtaaccttaccccgttcccgttaacccgggtttaccggttaccccgggggtttaaacgggggtaccccggggggtaaaccggggttaaacgggtaaaccgggtcgaaaacgggttaaccccggaacgggttaccggttacccggttacgggg

SEQ ID NO: 42163 - DNA, 694 bp, Homo sapiens
  misc_feature: GYAE6OF01EVEUW.52.75.G09.1.454.CMB.1.raw
  modified_base (311)..(311): a, c, t, g, unknown or other
  misc_feature (311)..(311): n is a, c, g, or t
  modified_base (464)..(464): a, c, t, g, unknown or other
  misc_feature (464)..(464): n is a, c, g, or t
  modified_base (514)..(514): a, c, t, g, unknown or other
  misc_feature (514)..(514): n is a, c, g, or t
  modified_base (531)..(531): a, c, t, g, unknown or other
  misc_feature (531)..(531): n is a, c, g, or t
tcagcgcagtacgacacgaccggtgctcgatttagtatagacatcaacacacaaacgggggcaggagtcagtcccaaccaggacacaggcatggacatggagggtccctgctcgagctccgtgggctcctgctgctctggctctcaggtgccagatgtgtcatccagactgacccagtctccatcctccctggtcctgccatcgtatacggagactagaactccaacctatcacgttgccgggtacgagtcgagtacatttaagctaatgtaatcgtggaactttggtaactcgaagaacctaaaaccggnaaacggcctaaccgtaccctaaccttcgtactacctccgtagactacgtacctaacgttaccgtaaccgtttaacgggtaaacccgtaacgggttaccccgtaaagttaacccggtaagggttcgacgggttagggtaacggtcgggtaccgnttacgttacgggtaacttaacgttaacttttaaccttaccgtaaccgtanaccgtacgtacgacgtncgtacgtacgtacgtacgtacgtaagtaacgtaactacgtacgtaactaactaacgttactacgtacgtaacctacgtacgtacgtcgtacgtaccgtcccgttacccgtaccggtaccggtaccgggttacggggaccgggaacggtaagggtacggtaacg

SEQ ID NO: 42164 - DNA, 692 bp, Homo sapiens
  misc_feature: GYAE6OF01C58C1.52.75.G09.1.454.CMB.1.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (612)..(612): a, c, t, g, unknown or other
  misc_feature (612)..(612): n is a, c, g, or t
tcagcgcagtacgacacgaccggtgctcgatttagtatagacatcaacacacgaaagggggcaggagtcagtcccaaccaggacacagcatggacatgaggtccctgctcagctccgtgggctcctgctgctctggctctcaggtcgccagtagtcgtgtcacttccgaagtacgtccgaaccctacgtcctacccgtacttccctcccgtgtcctagacatcgtaagaggacgaacagtacncactagtcacgtcggccggatacgcgactactataacgnttaattctagtagtagttagactacgaacgaaaccaaaaccggtgaaccgtacctaacccctaagtccgtacgtacttccgagtactgacctacgtacctaaggttaaccgaaacggtcggaccaagttacgtaaaggtcggaagttacggacgtacgtacgtaggtacggtacttaacgtttaacttttacgaccttaacgacgttacaacgggttaccaggtacccgttacgacggttacgaccgtaaaggtaaccgagttaacggtacaacgtaattaacgtactacgtacgtacaaacgtagtagtacgttaactcggtaccccgntttaccggtccggttacggggtaccgggaacgggtcgtaaaggttggaaaccctagaaccggaacgtcggcgtttacggg

SEQ ID NO: 42165 - DNA, 769 bp, Homo sapiens
  misc_feature: GYAE6OF01D1EOR.52.75.G09.1.454.CMB.1.raw
  modified_base (152)..(152): a, c, t, g, unknown or other
  misc_feature (152)..(152): n is a, c, g, or t
  modified_base (662)..(662): a, c, t, g, unknown or other
  misc_feature (662)..(662): n is a, c, g, or t
tcagcgcagtacgacacgaccggtgctcgatttagtatagacatcaacacacgaaagggggcaggagtcagtcccaaccaggacacagcatggacatggacgggtccctgctcagctccgtgggctcctgctgctcgtggctctcgaggtcncagtatgtgtacactccagtactacgacccgtatcctacctccttccccttccgttcgtcgtacgtactacttacgtaacggtaaggaacgacaagtaacctaccaacctacgtcgtacggtcgggccggtagacgtacggagtacttagtacgtacttacgttaagtacgttagttaaggttagttacggttaaacaaccggaaaacgaaaacccggtaaaaccgggacccggtaaccctaaaccccgtaaacctaccgttccaagtttacccaccgtagtactacgtacttaccgtaaacgttacgtaacgggtaaaccgttccggtaactacggtaacgtaaggttacgtaacgggtaggtacggtctaaggtccggttaagaaggtttactttactttaccaacgtacttacgacggtaacgcgtaaccgttcgaccgtacgtaccgtagaacggtactaacgtgtacaactaacttatacgtactagttaacgacttagtacgtntaccgtacctacccggttccgtaacggttcccggggttaagggggtaccgggggttaaccgaacgggtaggtaacgtaacggtaaggtaccaagggttcccgtaggg

SEQ ID NO: 42166 - DNA, 844 bp, Homo sapiens
  misc_feature: GYAE6OF01EPDFT.52.75.G09.1.454.CMB.1.raw
tcagcgcagtacgacacgaccggtgctcgatttagtatagacatcaacacacgaaagggggcaggagtcagtcccaaccaggacacagcatggacatgacgggtccctgctcagctccgtggggctcctgctgctcgtggctctcgaggtcgaccgagtattgtcgtactactccgagtactaccgacccgtacgtcctacctaccttcccttcccgttgtccacgtactacttacgttaagaggaacgactaacgtaacaccacctaactccgttacggtccgggaccgggtacgtacgtacgaacgtacttaacgtacgacgttattacgttacttagtaggttacgtttaggtaactaccgaaacgtaaaaccgaaaccggacggaaccctaccccgttaaccctaaccgtactacggtacccttacgtactaacgtaccgtactaaccgttaaccgttaacggttaaacgggtaacccgggtaccgtacctaacggttacggtaacggtaggttacggtacgggtaggtcggtcgttaacgggaaccggtttactaacgttttttacctttacgtaccacgttacaacggcttaacgggactcggtacgtaccggtaacgtaacttagggtaactacgttacgtaacctaactaacgtttaacttagttacgtaaaccgtaaacgtacgttaaggttctaaacggtttccgttacccttaccccggtaccggtttccggttaaacggggttcccggggtaacggggggaaacccgggttaaggaacggtttaccgggaaacgtttacccggaacgggtaaccgtttgggtaaaccccggg

SEQ ID NO: 42167 - DNA, 865 bp, Homo sapiens
  misc_feature: GYAE6OF01DLNPI.52.75.G09.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
tcagcgcagtacgacacgaccggtgctcgatttagtatagacatcgaacgacacaaaggggcaggagtcagtcccaacaggacacagcatggacatgaggtccctgctcagcctccgtgggctcctgctgccgtctggcctcgtcaggtcncagatgtgcagtccgagntcgacccagttcctccagttccctcccgtgtacctgactacgtctaacgtaggagacctaagaacctccaacctagtccgtacgttggcccgggtacgtaacgtcgaacggtaccaagtttaacgcgtaagttcgtaagttacctaggttaaagttacggttaacgttaccgaaacgaaaccgtaaaaacccggtaggggtacccaacccgggtaccccttaaaacgttcccgtagtacctaccgtacgtaagtccgtacgtactaccgtaacgttacgggaaaccgtacgggtactaacggtaccgtaacggtctacggtacgggaacggttagtaccgttaccggtaagggtaccttaacggtttaccttttaacccgttacaaccccgagttacgacggttacggaacgggtctacggtaccgtccggtaaccgtaacggaccttaagggtacttaacccgggtaaactaacctaaaccgttttaaccgggttttacttacccggtttaaacgtaaccggttacggtttaacggaacccggtttaaacgttcggtttacccccgttaaccccgggtaactttacccggggttacccccggggttaacgggggtaccccggggggtaaacgtaacgggggttacccggtaaaggtacccgttaaccgggtaaaggtaacccggttaacccgggg

SEQ ID NO: 42168 - DNA, 687 bp, Homo sapiens
  misc_feature: GYAE6OF01EGS77.52.75.G09.1.454.CMB.1.raw
tcagcgcagtacgacacgaccggtgctcgatttagtatagacatcagggggctgggggtctcaggaggcagcgctctcgggacgtctccaccatggcctgggctctgctattcctcaccctcctcactctgggcacaggactcccgggcccagtctcgccctgactcagcctgcctccgtgtctgggtctcctggacagtcgatcaccatctccgtgcactcggaaccagcgagtgactagtttcggtcgttaataactatgtctcctggtaccgacaaccacccggacaaacgcccccaaactcatagatttatgctgtacacttatcggccgcagggtatttctcagtcgccttctcgtggccttacgaacgttcacggtaccaaaccgtaccggcccttccccgtacaacctacttcctacgttcggggtccttccgtcgaacgttacggaacgggaaccggacgggtctagttaacttttaacgttaccgtgtaccacgttcctaacgttactttaaaccgaacgaccctaacccaaccctaccttaccgttacgttaaaccttccgggttaaccgggacgggaaccgggtaaccgtaagtaccggtaccgggtacccgttaccgtaacgggttaccaaccgggtaaccccaacgggttccccgccccggttacccccccggg

SEQ ID NO: 42169 - DNA, 691 bp, Homo sapiens
  misc_feature: GYAE6OF01CMW28.52.75.G09.1.454.CMB.1.raw
  modified_base (221)..(221): a, c, t, g, unknown or other
  misc_feature (221)..(221): n is a, c, g, or t
tcagcgcagtacgacacgaccggtgctcgatttagtatagacatcaacacacgaaagggggcaggagtcagtcccaaccaggacacagcatggacatgagggtccctgctcagctccgtggggctcctgctgctctggctctcgaggtgccagagtgtgtcatccagactcgaccctatcctccactccctcctgtctgcatcgtaagtaggagacataanccacctatccacgttcggccggcgaggtacgaagactagttacagtattagtacgtataggtaattggtaactacgaaagaacccgaaaaacggacggaaccgaaccctaaaccccgttaactaccgtagaccttctacgattacgctactacgtaacggttaaggaaccggtacggtacaacgtacggtaaggtaccgtaggtacggtaacggtcggtaccgttagggtaacgtaaccgttagttttaacccgttttactaaccgtaacgttaacgtacgtaacggacgtacgggtaccacggttaccgacggttaccgtaagaaccgtacgttacgaacgtaacctaagttaacttaaccgtattaacgtaccaagtacgtaagtacgtactaaccgtccttaccgcgttacggtcgggttacgggggaccgggttacgaaggtcgaagtacacgtaggcgtaacggg

SEQ ID NO: 42170 - DNA, 764 bp, Homo sapiens
  misc_feature: GYAE6OF01D9KCW.52.75.G09.1.454.CMB.1.raw
tcagcgcagtacgacacgaccggtgctcgatttagtatagacatcaacacacgaaagggggcaggagtcagtcccaaccaggacacagcatggacatgacgggtccctgctcagctccgtgggctcctgctgctcgtcggctctcgaggtcaccgagacttggtctcactccgagtactccggacctagtcctcctaccttccctccgtgtcctacgtactagttacgtagacggaacaactaagtactaccacgtactcgtacggtccgggacgggacgtacgtacgaacgtaacgtacgttacggtattacgttacgtaccttaggttaaggttacgtttacggaactaaccggaaacgaaaaaccgtaaacggacggaaccctaccctaacccgttactcctaggtaccctaccgtagtacctcgtaacttccttaacgaacgggttaacgaacggggtctacctaagttaacgggataggggtaacgcggtaaggtcgtacggtacggtttaaggttacttaacgtttttaccgtttaccgaacttacgtagtaaccggagtaccggtacgttacgcttaacccgggactagggtaacacgttaacgcgtaaactacgttattacgtaacctttacgaacaacgtacttaagacgttacgtacccgttacgacccggtttcgtaccggtagggttacccggggtaacgggccggtaaaggtacggtaccgtaggaacccgtacggtcggaaccggtttgg

SEQ ID NO: 42171 - DNA, 739 bp, Homo sapiens
  misc_feature: GYAE6OF01CR6ZB.52.75.G09.1.454.CMB.1.raw
  modified_base (185)..(185): a, c, t, g, unknown or other
  misc_feature (185)..(185): n is a, c, g, or t
  modified_base (313)..(313): a, c, t, g, unknown or other
  misc_feature (313)..(313): n is a, c, g, or t
  modified_base (519)..(519): a, c, t, g, unknown or other
  misc_feature (519)..(519): n is a, c, g, or t
  modified_base (558)..(558): a, c, t, g, unknown or other
  misc_feature (558)..(558): n is a, c, g, or t
  modified_base (616)..(616): a, c, t, g, unknown or other
  misc_feature (616)..(616): n is a, c, g, or t
tcagcgcagtacgacacgaccggtgctcgatttagtatagacatcaacacacgaaagggggcaggagtcagtcccaaccaggacacagcatggacatggacgggtccctgctcagctccgtggggctcctgctgcctctcggctctcgaggtcgccagatgtgtcactccgagactaccgacccncgttcctaccaccttcccctcccttggtctcgtacctattacgtaagtaagggaactaacgagtaactccacctatccgtacggttcggggaccggggactacggtacgaacggtactaaggttacgntacgttaggtactagtagttagttacggtacaaccgaacgaaaaccgaaacggaccgggtaaccaccccggtaacccttaactcccgtaacgtacgtcccgtaggtaacgtccaacgttacctaaccggttaacggttaaccgggaaaccggtaccgggttactaagttacggtaacgtttacgacggtaggggtacgtcgtacgnggttaaccggtattacgtttactttaccgtactaccgtntaccgaggtacgtaggtcctacgacaacggtagtaacgtactacgtactaacgttaanaaccgtttaatactaccggtaatacggtaagtctacggtactccgtccgtacgaccggttcggtacgggggtacggacggggtaccgtaagggtcgtaacgacgttacgacgtcgtaggtcgg

SEQ ID NO: 42172 - DNA, 884 bp, Homo sapiens
  misc_feature: GYAE6OF01ET62H.52.75.G09.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
tcagcgcagtacgacacgaccggtgctcgatttagtatagacatcaacacacgaaagggggcaggagtcagtcccaaccaggacacagcatggacatgagggtccctgctcagctccgtgggctcctgctgctctcggctctcgaggtcgccagtgtcgtgtcaagtccaagtacgtacgaccccgntcctcctaccgttccctccctgttccncgtactactacgtaagtacggaacaacgtaacaactccacctactcgtacgttcgggaccgggtagtacggaccgaagtaaccgtaagtacgactaggttacgttacgttacgtaggtaagttcggtaacgtaaccgaaaacgtaacccggaaaaaccgtaccgggaactaaccccctaaccgttaaccgtaccgtacgtaccctccgtaaccgtactcggtaacccttaccggtttaactaaccggttaaccggggtaacgttacccggaacgttaccggttaaacgttaccggttacggtaggtaacggtacggttacggtaccgttacgggtacgttaaccgttaacgtttacgttttaaccgtactaacccgtacgtaccgacgtacggtaacggtccgtacgtacccggtacgtaaccgtaacggtacgttaacgtaccgtaacgtaacttaaacggttaccctttaacggtttacccgtaaaccggttaaccgttaacgtaccggtttaattaaccggtaacccgttttccggtaccggtaccccggtttccgtaaacccggggtttacccgggggtaacccgggggtttaaccggggtacccgaaaacgggtccgggtttaaaccgaaccggggttaacctaacgggttaaaccgggttcggg

SEQ ID NO: 42173 - DNA, 719 bp, Homo sapiens
  misc_feature: GYAE6OF01CWKRR.52.75.G09.1.454.CMB.1.raw
  modified_base (122)..(122): a, c, t, g, unknown or other
  misc_feature (122)..(122): n is a, c, g, or t
  modified_base (161)..(161): a, c, t, g, unknown or other
  misc_feature (161)..(161): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (371)..(371): a, c, t, g, unknown or other
  misc_feature (371)..(371): n is a, c, g, or t
tcagcgcagtacgacacgaccggtgctcgatttagtatagacatcaacacacgaaagggggcaggagtcagtcccaaccgaggacacagcatggacagtggacggtccctgctcagctccgngggctccgtgctgactctggctatcgaggtcgccaagtntgtctacagtccagactcgacctgtcctacacgtccctctgtctagactatacgtanacggaanacctaanacctaccactacgtctacggtggacccggagtacggacgtaagactagttagctagtagtctacgtagtagtagtacacgaacgtaaacgaaaccgacggtaacctaaccgacctaaacgccgttactaacgtccgtanactacgtacctaccttaaccgttaacggttaacgaaaccgggtccggtacccgttaagtaaccgggttaagtaccggtaaacggttacgggtaagtacccgggttactacgggtaacgggtacttaacgttttaaccgtttaccgttaccgaaccttacggactaacggtacgacgttcgtacgtacggtaccgtacgtaagacccgtattaacgaacctacgaacgttacgtacgttacgtaaccgtaactaacgtcgttaaagtcgttacgacccggttcaccgtacgttcccggtaacggtccggggaccggtaagacggtacgagtaacgcgaccgtgtaccgg

SEQ ID NO: 42174 - DNA, 741 bp, Homo sapiens
  misc_feature: GYAE6OF01DBEB2.52.75.G09.1.454.CMB.1.raw
  modified_base (200)..(200): a, c, t, g, unknown or other
  misc_feature (200)..(200): n is a, c, g, or t
tcagcgcagtacgacacgaccggtgctcgatttagtatagacatcaacacaacaaagggggcaggagtcagtcccaaccaggacacagcatggacatgagggtccctgctcagctccgtgggctcctgctgctctggcctctacgaggtgccagatgtgtcatccagtatcgacccagttcctcctactccctcctgtcngtctactcgtagtaggagacaagtaactaccaccaatccgtacggtcggccgggtagacgtcgaagtactaagttacgacttaagtgtactacgtaggtagttacgtacgtaacaacggtaaaaccgaaaaccggacgggtaccctaacccgtaacccccttaactccgtaacgtacctaccgtacggtactcgacctaaccgttaacccgttaacggttaacgggtaaaccggtcccggtacctaagtaccggttaaggtacggtagggtagaacggttcgtacccgtaggtaacgttacttaacgtttaccttttacgttacactagtacacggtcgacggtcacggacctaacgtacgagtaacgacttatacgaactactaattaccgttaacacgtaacctaagttcgtaagttagttaccgtccgttaccgtacccgttcggttaccccgggttaacggggttaacccgggggaacgggtaacgggtaacgggtaactaacgggtactaaaccggacgggttaacgtaaccgggg

SEQ ID NO: 42175 - DNA, 752 bp, Homo sapiens
  misc_feature: GYAE6OF01CY8AG.52.75.G09.1.454.CMB.1.raw
  modified_base (154)..(154): a, c, t, g, unknown or other
  misc_feature (154)..(154): n is a, c, g, or t
  modified_base (158)..(158): a, c, t, g, unknown or other
  misc_feature (158)..(158): n is a, c, g, or t
  modified_base (230)..(230): a, c, t, g, unknown or other
  misc_feature (230)..(230): n is a, c, g, or t
tcagcgcagtacgacacgaccggtgctcgatttagtatagacatcaacacacgaaagggggcaggagtcagtcccaaccaggacacagcatggacatgagggtccctgctcagctccgtgggctcctgctgctctggctctcgaggtcgccagntgtntcactccaggtactcgaccctgtcctccacttccctccgtgtctgactatacgtagaggagacagtaaaccncaactacttacgaccgttcggggccgggacgtaggtcgaagtacgtattacggattattagttcgttactagggtaacgtttacggtaactaaccgaacgtaaaaccaaaaccgggacggtaacccgtaaccctaaccccttaaactccgtaagtaacctcccgttagaaccttcaaccgttaccgttaacgttaaacgttaccggggaaacgtccggttaacaaacggtttccgtaacggttagacgggtaggttacggtcggtaccttacgggaacggttacgtttaacgtttaacttttaccgtaccgtactacgttacgcgtacgtacggttccgtacgaccgacgtaccgtagtaacttacgtagttaacgaacctaacgtttagttacttaccgtagtacctaagttacgttaagacttaaccggtcctacccgttcccgtaaccgtacgggttaaccgggttcgggggacccgggaaattaccgggtaggtactacgggtacaaggtcggtacgg

SEQ ID NO: 42176 - DNA, 734 bp, Homo sapiens
  misc_feature: GYAE6OF01EQC1H.52.75.G09.1.454.CMB.1.raw
  modified_base (705)..(705): a, c, t, g, unknown or other
  misc_feature (705)..(705): n is a, c, g, or t
tcagcgcagtacgacacgaccggtgctcgatttagtatagacatcaacgacacaaaggggggcaggagtcagtcccaaccaggacacagcatggacatgagggtccctgctcacgctcctggggctcctgctgctctggctctcgaggtcgccagtagtgtcgggggtctactccgagatcggaccctacgtcctaccctacttcccttccctcggttctcgctactaccgttaagaacggaacgaacgtaacgaaactaccaacctactacctacgttcggccgggtacggtacgtacggaacgactaagtacacgtagtacgtaacttcgtacgtaagttagtaagtacgaaacgaaaccgaaaaaccggacggaacccgaacccggtaacccctaaaccgtctaccgtacctacgtacgtacgtctactactaaccgtaacggttaacggaacgggtacggtaccacgtaacgtaacggtacgtagggtagtacggtcggtcgtcggtacgtaacttagtttactttacctacctactaactcggtacgcgtaacgtctacggtactacgtaccgaagtaacgtacgttaatacgtaaacgttaactaattaagttacctacgtaaacggtaacttacgggtaatacgttataccctcgtaacccgtcttaacggggtccggttacgggggacgggtaacgngggtacgactaacgtacgaggacgttacg

SEQ ID NO: 42177 - DNA, 702 bp, Homo sapiens
  misc_feature: GYAE6OF01AUL9H.52.75.G09.1.454.CMB.1.raw
  modified_base (144)..(144): a, c, t, g, unknown or other
  misc_feature (144)..(144): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (546)..(546): a, c, t, g, unknown or other
  misc_feature (546)..(546): n is a, c, g, or t
tcagcgcagtacgacacgaccggtgctcgatttagtatagacatcaacacacgaaaggggggcaggagtcagtcccaaccaggacacagcatggacatgagggtccctgctcagctccgtggggctcctgctgctctggctctnaggtgcagatgtgtcatcagangaccctgtccnctactccgtcctgtctncattactaanacggagtacaagtaactcaaccatcgacgttcggaccggggcgacggtacgacgtaatattacgctatagtactntagtaattggtactacgaacaaccaaaacgcggaaccaccgtaccctaaactcctagactccgtactagngtacactaccgtaacgttaggaaccgtacggggtaccctaggtaccgtaaggttacgtaggtagggtagtacggacgttacggaggggtaacttaagtttacgtttttaacccttacaacccgttaataccgggaacgtaccgtacggggtaccctggtaaccgtacggacgttaacggaacgttaaccgtattaanaacccgtaaattaaccgttacgtaacccttaggaactaacgtagtataacggtaactacgtacccgtcccgtcgtacccggtttacgggttccggggaaccggggtaaacgtacgggttaggaacggtaatccggtaaaaagggtcggtaaaccgg

SEQ ID NO: 42178 - DNA, 803 bp, Homo sapiens
  misc_feature: GYAE6OF01DUAFQ.52.75.G09.1.454.CMB.1.raw
  modified_base (115)..(115): a, c, t, g, unknown or other
  misc_feature (115)..(115): n is a, c, g, or t
  modified_base (155)..(155): a, c, t, g, unknown or other
  misc_feature (155)..(155): n is a, c, g, or t
  modified_base (233)..(233): a, c, t, g, unknown or other
  misc_feature (233)..(233): n is a, c, g, or t
tcagcgcagtacgacacgaccggtgctcgatttagtatagacatcaacacacgaaaggggggcaggagtcagtcccaaccaggacacagcatggacatggacgggtccctgctcngctccgtgggctctgctgctgtggctctgaggtcgcagtntgtcgtcatccgagactccgaacctgtcctacctcgttccctccgttgtctcgactattacgtaaggacggaacgtanaagtaccactacctataccgtaccggtcgggggaccggtcgtacggacgaacgttaactagttaacgacttaaggttactcgttagttaaggttaacgtttaggactaaaccgaaaccgtaaaaccggaaaacccggaccgtaaacccgtaaccccggtaaacccctaactaccgtacttaacccgtcacggtactacgtaacccttaccgttaaacccggtaagggttaaccgggaaccggggttcccttaaacgtagttacgggttaacggtagtaacggtgggtaaccggttgtaccgtacgggtaacgtacgttacgtttactttacctaccgtaactcgtagtaccggtacggtaccgcggtacgaccggtaaccgtacggtaactaacgttcgtaaccttaagtaaccttaattacttaaccgtttacgaaacgtacgttaagtacgttaacgtacgttcggttacccgtcccgtttacccggtacccgttacgggggtaccggggttacgggaccggggttaaggcgggtacgtaacggacgtacggtaggtacccgtaaggg

SEQ ID NO: 42179 - DNA, 655 bp, Homo sapiens
  misc_feature: GYAE6OF01A0HL2.52.75.G09.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (478)..(478): a, c, t, g, unknown or other
  misc_feature (478)..(478): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggccagtctgccctgactcagcctgcctccgtgtctgggtctcctggacngtcgatcacntcncctgcacgtgaaccagcaagtcactgttggtacttatactatcgtctcgtaggtaccacaaccgacccgacaaaccgccccaaatcatagtatttacncgcttcgtactacttacgccggacccgtgacgggtattttccgctacgttcgtacctttctcgtcggtacctaccgtagtcctacggaacaaccggacccgtcccttaccctaccgaaccttgtcccgtttagtccgggtacctccgtaggtacgtacgggacgtaaccggngtacgttagtaacttttacgtactcgtacgtaaccgttctacgttaacttaaccgaaccgtaccctaaccctaccgtaacttaccgttacggtacctccggttcgggaaccggtaacgacgtacgtccgtagtaccgtacgtcgtaccaccggaccctacggcccgttacgtccccg

SEQ ID NO: 42180 - DNA, 809 bp, Homo sapiens
  misc_feature: GYAE6OF01A49B3.52.75.G09.1.454.CMB.1.raw
  modified_base (287)..(287): a, c, t, g, unknown or other
  misc_feature (287)..(287): n is a, c, g, or t
  modified_base (776)..(776): a, c, t, g, unknown or other
  misc_feature (776)..(776): n is a, c, g, or t
tcagcgcagtacgacacgaccggtgctcgatttagtatagacatcagggggctggggtctcaggaggcagcgctctcgggacgtcctccaccatggcctgggctctgctagttccctcaccctcctcacctcgtcgggccacgacggtacgtcccccggggccctaaggttcctcggccccttggacctccgacgtccctcggcccttccggtcgtccgttcgggtcctccggtcggacagtcgtaacgtccacctagttcctcccgtgccctaacgtcgggaaccncggcctaaggtcgaaccgttaggttttcggggtacctttaataacgttgttccgttccgttaccggtaccggtaacccaaccgaacccggtaaccccggaaccgaaaccccgaccccctaaaactccgtaattacgttactttacgcggtccttacgtaccttaaccgttcggcccgggacccgtacggtaggttcctttaccgcgtacgttccgtaccgttccgtcggttaccgaccctacgtaccgttcggtaccgaaacccacccggtcccgtccctcccgaactacctcgtccgtcggtccgccttaccgtgaccgtcggacggtacgacgttgtacttaacttacgactcgactcgtaacttccgttaactaaccgactaaccctaccttacctacgttaccttacggtaccgttcgggtaccgggtaccggaaccggtaaccgtgtccccggtaaccggttacccgtacgtacggtaaccccncccggtacccggaccgttccccgtcccgtaccc

SEQ ID NO: 42181 - DNA, 697 bp, Homo sapiens
  misc_feature: GYAE6OF01B5K8W.52.75.G09.1.454.CMB.1.raw
  modified_base (132)..(132): a, c, t, g, unknown or other
  misc_feature (132)..(132): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (351)..(351): a, c, t, g, unknown or other
  misc_feature (351)..(351): n is a, c, g, or t
tcagcgcagtacgacacgaccggtgctcgatttagtatagacatcagggggctggggtctcaggaggcagcgctcgtcgggacgtctccaccatggcctgggctctgctacttcctcaccctcctcactcgngggcacaggactcccgggcctagtcctcgccctgactcagcctgccttccgtgtcgtcggtctccgtggacagtcactccaacnctcctctacgactacgtacggaaccngacagtcgacttagttcggtacttaatacttatcgtccgtcgtacgtaaccgaaccaaccgacccgaacaaacccgtacccctaaaactcgtaattagttaactttacncgtcttacgtaaccttacgttccggcccggtcccgacggtaagggtttcctttcgtaccgttaccgttccgttccgttcgttacggtccggtaccttaaccggtaacggtcctaacgggtacccaaaccggtcccgtcccccttacccgtaccaccgttctccgtacggtcggtcctcgtcgtacgtggacggtacgacgtctagtacttagtcgtcgactacgtcttactaacttacgaactaccacctacctctacttactaccggttcggccggtaacggacgtacgtaacgcgtaccgtcgtaaccggtcgtaccgccgaaccgcgtcccgtcccggtaccg

SEQ ID NO: 42182 - DNA, 781 bp, Homo sapiens
  misc_feature: GYAE6OF01EOAAI.52.75.G09.1.454.CMB.1.raw
  modified_base (120)..(120): a, c, t, g, unknown or other
  misc_feature (120)..(120): n is a, c, g, or t
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagcgcagtacgacacgaccggtgctcgatttagtatagacatcaacacacgaaagggggcaggagtcagtcccaaccaggacacagcatggacaatggagggtccctgctcagctccnggggcctcctgctgctactggctctcaggtgccagtatggtgtacattaccagaacgtcgaaccctattcaccctactccccgttcccttgtaccngctattcgtaagagggaanacagaatccaacctanctacgttggcgggaccgagtacggagactattagctatagtatntagtaattggtatacaacgaaccgtaaaaaccgacgggaacgtaacccgtaacccttaaacctaccgttactaaccgttacctacgtattacacctactaacctaagtttaacggaaacggtacgggtaccacgtaacgttaacggtactaaggggtacggaaggttacgggacttacggtaggggtaactttaacgtttaaccgtttttaacttactaaccgtataccgaagtccgaggtactcgtaaccgacgttacggaaccgaaagtacggtactacgtaacgtaaactaacgtttaactttaccgtaaccgttaactaaacggattaaccgggttagtaaaccgtttccgttaacccgtttaccccgtcgtttaaccccggggtaacggggtttacccgggggggaaccggggttaaacccgggaaacggggttacggggaaataaacgggtaaacggtaaaccgggtcggttaaaccggg

SEQ ID NO: 42183 - DNA, 415 bp, Homo sapiens
  misc_feature: GYAE6OF02IE1X9.52.75.G09.1.454.CMB.1.raw
  modified_base (352)..(352): a, c, t, g, unknown or other
  misc_feature (352)..(352): n is a, c, g, or t
  modified_base (412)..(415): a, c, t, g, unknown or other
  misc_feature (412)..(415): n is a, c, g, or t
tcagcgcagtacgacacgaccggtgctcgatttagtatagacatctaacgtacggaacaaagggacgagtcgaggacccagttagtcagtgtatcgtgaattggtagtccaggcaaaaaccacgggacgagaccccgtaaacctccttcgatcctcgatgcatccgactttggaacaggggtcccatcaaggttcagtggaagtggctctgggacagattttactttcaccatcagcaggctgcagcctgaagacattgcaacatattactgtcaaacagtatgatagtctcccgctcacttttcggcggggggacccaaggtggagatcaagcgaactgtgctgcacatcngtcttcattctcccgccatctgatatacgatcgctgagcgggctgggcaaggcgcatagnnnn

SEQ ID NO: 42184 - DNA, 524 bp, Homo sapiens
  misc_feature: GYAE6OF02JISQS.52.75.G09.1.454.CMB.1.raw
  modified_base (323)..(323): a, c, t, g, unknown or other
  misc_feature (323)..(323): n is a, c, g, or t
tcagcgcagtacgacacgaccggtgctcgatttagtatagacatcaacacataaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgactcctcgatgcatccacttggaaacnggggtccatcaaggttcagtggaagtggctcgtgggactagtattttacttcacctatcagcaggctgcacgcctgaatacatttgacaacatattactcgtcaaactagtatgattacgtctcccgtcttacctacggtttccggggaccgggggtaaccgtaaggggttcggaacgtagtaccgaacggtccgtaacgg

SEQ ID NO: 42185 - DNA, 513 bp, Homo sapiens
  misc_feature: GYAE6OF02F0ZAX.52.75.G09.1.454.CMB.1.raw
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctcctggtaccgacaacaccccggcaaagcccccaaatcatgatctttgaggtcaatgatcggccgnagggtttcncatcgcttctccggctccaagtctgcagcacggcctcctgaccatcctctgggctccgaggctgaggacgaggctgattattactgcagctcatactacaaacagaaactacgttgggtgttcggcggcggacagacgtcgaccgtcctacgtcacgacccaaggccgtcgccccgtcgcctaccg

SEQ ID NO: 42186 - DNA, 631 bp, Homo sapiens
  misc_feature: GYAE6OF02GTUK9.52.75.G09.1.454.CMB.1.raw
  modified_base (303)..(303): a, c, t, g, unknown or other
  misc_feature (303)..(303): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctcctggacagtcgatcaccatctcctgcactggaaccagcagtcgacattggtcttataactatgtctcctggtaccacaacaccccggcaaacgcccccaaaatccatgatttangctgtcacttatccggccgcagggtactttctcatcgtccttctcgtggcctaccaagttcctagggccaaacgaccgggccctcccctacacctactcctcgtcgggccttcctagactggacggaccgaggcgttaggtaactttactactcgactacggtctactaactttacaacgtcccaacccgtaccctaaccctttacctaacgttaactccgtttacgggaccgggtaacgggaaccctaaggtccgtaccgtaacccgttacccgttaacgggttccctaaccggaccccgtaacggtcccgttcccgtaccccccgg

SEQ ID NO: 42187 - DNA, 525 bp, Homo sapiens
  misc_feature: GYAE6OF02GFBYA.52.75.G09.1.454.CMB.1.raw
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (422)..(422): a, c, t, g, unknown or other
  misc_feature (422)..(422): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatcctcctgcactggaaccagcagtgacattggtcttataactatgtctcctggtaccgacaacaccccggnaaagcccccaaaactcatgatttatgctgtcacttatcggccnagggatttcncatcgcttctctggctcaagtctggacaacgacggcctccctcaccatctcgtgggctcctgactgacggacgaggcttagatttacttacngcagctctaattacaagccaccacacctctagtaactcgttacggcggtacgggccaagctacgaccgtcgtacggtcacgcccgaaggcctacgtacccccg

SEQ ID NO: 42188 - DNA, 529 bp, Homo sapiens
  misc_feature: GYAE6OF02F8LXH.52.75.G09.1.454.CMB.1.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacatttggtcgttataactatgtctcctggtaccgacaacaccccggcaaacgcccccaaactcatcgatttatgctgtcacttatccggcccgcagggtatttctcatcgcttctctgctcaagtctgcacncgcctccncacatctctggctcngactgagacgngctgattatacngcngctctattacagtccaccacctactcgtataactccgttcggacggacgggaccaacgctacggtacccgttcgtacggtccgaaccgacccgtaacggtcctcccggtaccccccg

SEQ ID NO: 42189 - DNA, 503 bp, Homo sapiens
  misc_feature: GYAE6OF02IMHF6.52.75.G09.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggccagtctgccctgactcagcctgcctccgtgtctgggtctcctggacagtcgatcaccatctctgcactggaaccagcagtgacagttggtcttataactatgtctcctggtaccgacaaccaccccggcaaacgcccccaaactcatgatttatgctgtcacttatccggcccgnagggatttctcatcncttctctgctcagtctgcacacggcctcctcacatctctggctcgngtactgagacgngntgtatattacgtncagctctaatttacaagcaccaccactctagtacttcgtacgcgacggacacgngtcgaccgtactcggtcacgaccgacggcncgtaccccg

SEQ ID NO: 42190 - DNA, 601 bp, Homo sapiens
  misc_feature: GYAE6OF02ISO6V.52.75.G09.1.454.CMB.1.raw
  modified_base (147)..(147): a, c, t, g, unknown or other
  misc_feature (147)..(147): n is a, c, g, or t
tcagcgcagtacgacacgaccggtgctcgatttagtatagacatcaacgacacaaagggggcaggagtcagtcccaaccaggacacagcatggacatgagggtccctgctcagctcctggggctcctgctgctctggctctcaggtncctagatgtgtcattccagatgacccagtctccatccctccctgtctgcatctataggagacagaatccaccatcacttggccggagacgtcgagacattacgcatcgtatctagaattggtatcaagacaaaaaccgaggaccacgacccctaactcctagtactccgtgactgacatcctacttaggaacgtacgggtccatacgaagttacagtaggacgtcggctcgtaggactagtacttttaccttacactatacgacgtacgaggctagcacgtacctaggaacgtactacgttcgaacctaacttaacttaacgttacgtacgtaaccctaagtacgtacgttagtacttacgtaccgttacccgtacgttccgttaccggtttacggggacccggggtaacgtaacgggttacggacgttaaccgtacgtacggtaccgtaacgg

SEQ ID NO: 42191 - DNA, 746 bp, Homo sapiens
  misc_feature: GYAE6OF02H3LJ0.52.75.G09.1.454.CMB.1.raw
  modified_base (276)..(276): a, c, t, g, unknown or other
  misc_feature (276)..(276): n is a, c, g, or t
tcagcgcagtacgacacgaccggtgctcgatttagtatagacatcaacgacacaaaggggcaggagtcagtcccaaccaggacacagcatggacatgagggtccctgctcagctcctgggctcctgctgctctggctctcaggtgccagatgtgtcatccagatgacccagtctcatcctcctgtctgcatcataggagacagaatcaaccagtaccacttgccggtcgagtcgagacattagcatgtatctgaattggtatcagacaaaaaccgnggaccagacccctaaacgtcctagtactcctacggtactcggacctagtaccctacgttttaagggaaaccgtacgggggtacccctaaagttccgtaaaacgggttttcccaaacgggttgggtaaaacgtttcggggtaccgttaacccggttagggggtaaaccttaacgggttaactttttttttacccggtttaacctaacccggtaaacttttacccgaaggtaccgtaaccgggttcgttaaccggcctaacgggttccctaagggtaaactaccctaagttttacgggaaccctaaaaccggtactttaaccgtttaacgtccgtttaaccgaaccggtaaagttacgtaacgtaacttaaccttccgttaccccgttacgttacccgtacccgtttccggggaaccggtaccggggtaacaacggggtttccgaaggggactttaccggaacgtaacccgg

SEQ ID NO: 42192 - DNA, 702 bp, Homo sapiens
  misc_feature: GYAE6OF02J21K7.52.75.G09.1.454.CMB.1.raw
  modified_base (142)..(142): a, c, t, g, unknown or other
  misc_feature (142)..(142): n is a, c, g, or t
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (631)..(631): a, c, t, g, unknown or other
  misc_feature (631)..(631): n is a, c, g, or t
  modified_base (683)..(683): a, c, t, g, unknown or other
  misc_feature (683)..(683): n is a, c, g, or t
tcagcgcagtacgacacgaccggtgctcgatttagtatagacatcaacgacacgaaagggggcaggagtcagtcccaaccaggacacagcatggacatgaggtccctgctcagctccgtgggcctcctgctgctctggctcncaggtnccagatgtntcatccagatcgacccagtcctaccatccctcctgtacttcgctagttcctaagacgganaaccaagactaccgactactacacgttggcccggagacgtccgaagacagttacncctatgtaatcgtgaagttgtacacaaggaaccaaaaacgnggaccacggacccctaaatccgntaacctcgtaccgtaagttcgaaccgttactacccgtaaacggttacggaaaccgtacgggtcccaagttaccgaagtaccgtaagtagggtaacctggtaccgttaggacggtaacttaacggttaccttttttaccaaccggtaacccaggttaaccctaagggtccaacgggttccctaaagggtcctaacgaccgtttaacgaaacgtaccgttaagttccgaaactaactaacgttacttaccgttaacgaccgaaattacggtactcggtaatacccgtccgttaaccncgtttaccggaggttcccgggacgggaacctaggggttaccaaaccggttanaaccggtaccgaggtaccg

SEQ ID NO: 42193 - DNA, 859 bp, Homo sapiens
  misc_feature: GYAE6OF02FYEZJ.52.75.G09.1.454.CMB.1.raw
  modified_base (127)..(127): a, c, t, g, unknown or other
  misc_feature (127)..(127): n is a, c, g, or t
tcagcgcagtacgacacgaccggtgctcgatttagtatagacatctaacgtacggacaaaagggggcaggagtcagtccaaccaggaccacaggcatggaaccatgaggtcctgtctctacgctccngggctcctggctcgctactggctctcaggtgccagatgtcgtcagtccacgtatcgtacccagttcctccgactccctcctgtcctcgcctagtccgtactaggacaactagtaacctccgaacctattcaccgttcggacccgggagacgttaccgaaacgtacgtacttacggacctacgtaggttacttcccttaaggtaacgtttcggtaactaacgtaacggtaaacctaaaaaaccggtacggggaaccgaccggaaccccccggtttaaaactcccgtaacgtaaccttaccccgttacggtaacgttcgccgtaaaccgttcccgttaaacgggttttacgggaaaaccggtccggggttaaccctaacgtttaccggtaaacggttccgtaacggtacggggttaaacgtcggtaaccgttacggtacggggtaaaccttaaggtttacctttttaaccgttacccgtaaacgttacgtttacgaacggttaccgtagttaccgttacgaccgtacgtaccgtaacggtaacgtaactacgtttaaccacccgtaaaccttacgtttaacctttaccgtaccgttaaaccgtaaacgtaacgttaacgttaacgtacgttacgtacccgtaccgttaacctaaccggttaaccgggtttaccggggacgggtaacccgttagggtaccggtaacttacgtaaccgttaacgtccgttaaccgg

SEQ ID NO: 42194 - DNA, 511 bp, Homo sapiens
  misc_feature: GYAE6OF02GGK0T.52.75.G09.1.454.CMB.1.raw
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggcgttataactatgtctcctggtaccgacaacaccccggcaaaagcccccaaaatcatgatttatgctgtcacttatcggccgcagggatttcgcatcgcttctctggcttccaagtcgtgcaaacacggcctccctcaccatctctggctcctgactgagacgaggctgattatactgcagctcatttacaaagtcaaccacctactctgtaatcttacggcgtagggacaagctcaccgtacctaggtctacgacccaacggctgtacccccg

SEQ ID NO: 42195 - DNA, 893 bp, Homo sapiens
  misc_feature: GYAE6OF02FFQTT.52.75.G09.1.454.CMB.1.raw
tcagcgcagtacgacacgaccggtgctcgatttagtatagacatcaacgacacaaagggggcaggagtcagtcccaaccaggacacagcatggacatgagggtccctgctcagctccgtgggctcctgctgctctggcctctcgaggtcgaccagtatgtcgtcactccagactcgaccctagtcctccacgtccctccgtagtcctcgacctacgttaccgtaagtacggacaacgtacgaacctccaacctactaccgtaccggttcggaccgggtcgtaacggtacgaacgtacttacggttacgacgtagttacgttacgtacggttaagtaggttacgacgtaaccgaaacggtaaacccgtaaaaccggtacggtaaccctaaccccgtaaccgtttaaccgtccgtacgttaacctacccgtacgtaacgtccgtaccgttaccgtaaccggtttaacgggtaacccgggaaacccggttaccccgggttaacctaacgggttaaacccggttaacggggtaccgttaaaagggggtacccgggggttaggtacccggttaacgggttaccgggtaaccgggttaaaccttttaccgtttaaccttttaccccggtaaccaacgttaacccggagtacccggtacgacggtacccgttacggtaaccctaccgggttaccgaaacggtaccttaacgtaaccggtaactaaaccggtatttaaccgttaaccgttacgttaaccgtaacgtaaacttcggttaagttacccgtaccggtttcccgtacccggtaccgtttacccgggacgggtttaacccggggtacggggtaaccgggtaagtacggttacggaaccgttaggaacccgtaggttaccggtacgg

SEQ ID NO: 42196 - DNA, 700 bp, Homo sapiens
  misc_feature: GYAE6OF02HQ9IY.52.75.G09.1.454.CMB.1.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccgggcccagtctgccctgactcagcctgcctccgtgtctgggtctctggacagtcatcaccatctcgtgcacgtggaaccngcagtgactagttcggtacttaataactagtgtcctctggtaccacaaccaccccgacaaacgcccccaaacnccatgtactttancgcttagtcctacgttacgtcccggcccgtcgacgggttattttcctacgtactccgtccttccgttcgtcggaccttaacccgtaaagttccgtgggtacccaaaaccggcccggtacccctttacccctcctaacccttatcccttacggtccggtccttacccgtgtacgtcggaggacgcggtcgttacgttatttaacgttctacgctaccggttctaacttaagttaccaacgtaccctaacccgtacctaaccgttaccgttaacgtttacgttaccggttaccgggaccgggtaacggtacccgaacggttcggaaccgttacccgggtacggttaacgacccgtaaccgaccgtaaccggacccgttccccgtacccccgg

SEQ ID NO: 42197 - DNA, 608 bp, Homo sapiens
  misc_feature: GYAE6OF02IJVVA.52.75.G09.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (328)..(328): a, c, t, g, unknown or other
  misc_feature (328)..(328): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctcgccctgactcagcctgcctcgtgtctggtctcctggacngtcgatcaccatctcctgcactggaaccngcagtgactattggtcttaataactatgtctcctggtaccgacaaccaccccggacaaacgcccccaaactacatgtatttatgctgtctacttagtcggcccgngacgggtactttcgtctatcgtccttctcgttcgctcctaagtcgtaggccaacgaccggtaccctccccgtaccacctaactccttaccgtcggtcctacccgtcgtacgtacggacgggacggaggtcttagtaacgtttacgtactgactacgtctacttaattaccaacgacctaccacctacctcttaactaacgttcgttcgggacggtacggaacctacggactacgtacccgtacgtacggcctaccgaccgacggtcccgtccgtaccccg

SEQ ID NO: 42198 - DNA, 734 bp, Homo sapiens
  misc_feature: GYAE6OF02FF0R1.52.75.G09.1.454.CMB.1.raw
  modified_base (653)..(653): a, c, t, g, unknown or other
  misc_feature (653)..(653): n is a, c, g, or t
tcagcgcagtacgacacgaccggtgctcgatttagtatagacatcaacacacgaaagggggcaggagtcagtcccaaccaggacacagcatggacatgagggtccctgctcagctccgtggggctcctgctgctctggcctactcgaggtcgccagatcgtgtacatccagtactccgaccctacgtcctcctactccctccgtagtcgtcgactataccgtagaggacaaccagaacctccaccgtagtccgtccggtcgggcccgggacgacgtaccgaacgtacctattacgctaagttcgttactcggttaagtacgttacgtaaccgtaacgaacggaaaccaaaaaccgggtcggaacccaacccgtaaccttacctccagtaccgttaccgcgtactacgtacttaaccgttaccgtaacggtaccggaacggtaccggtaaccaggttaacggtaggtccgtaagggttacgtacggtcggtacttacggtaacgttaactttacggttaccttttacgacctaaccgagacggactacggtacgccgacggtacctaccgaacgttacgaattacgtacgtaataacctattactttaggtaactactaaaccgagttactagggtacctacgtaccggtcccnccgggtttaaaccggtcgggttaaccgggtacggggaccggaaggtacgtacgggaacctcgaacgtacggtaggtaccgg

SEQ ID NO: 42199 - DNA, 654 bp, Homo sapiens
  misc_feature: GYAE6OF02IJWE6.52.75.G09.1.454.CMB.1.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (521)..(521): a, c, t, g, unknown or other
  misc_feature (521)..(521): n is a, c, g, or t
tcagcgcagtacgacacgaccggtgctcgatttagtatagacatcagggggctggggtctcaggaggcagcgctctcgggacgtctccaccatggcctgggctctgctatcctcaccctctcactcgtgggcacaggactcccgggcccagtctcgccctgactcacgcctgccctccgtcgtctcgggtctccgtaggacaggtccatcaacctntcctctgaccacgtaggaaccnggactagtnactagttcggtcttaactaactatgtacctcgtaggtaccgaacaaccgaccccggacaaaaccaccccctaaaattaccagttagtacttttacgcacgttctacctaacgttacgtccggacccagtacgggttactttcaccgattccgtctcgttacncggtactccgtaagtcngaccaaacgccgtccttcacacgtactctcgtacggtcctcttaccganaggaccggganacggtacngtttaaactttacgaccttggaacccncgttaaccttacgttaacaaccgtaaccacccaacctacctacgtactaacgtactccggtaggaaccggacgaaccacgtccgtaccgtaccgtactacgaccgtaccgaccgtaccgtacccgtccctccg

SEQ ID NO: 42200 - DNA, 619 bp, Homo sapiens
  misc_feature: GYAE6OF02FGLD0.52.75.G09.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (344)..(344): a, c, t, g, unknown or other
  misc_feature (344)..(344): n is a, c, g, or t
  modified_base (417)..(417): a, c, t, g, unknown or other
  misc_feature (417)..(417): n is a, c, g, or t
tcagcgcagtacgacacgaccggtgctcgatttagtatagacatcagggggctggggtctcaggaggcagcgctctcgggacgtctccaccatggcctgggctctgctattcctcaccctcctcactctgggcacaggactcccggccagtctcgccctgactcacgtcctgacctccggtgtcgtgggtctccgtggacagtcgatcacatcctcctncactcggaacngcagtcactgttcggtacttaataactntcgtcttccgtaggtaccactaaccgaccccggaanaaaccgccccctaaanctaatntattancgtctgtctactcgccgaccgngacgtctttcagtactcgtactctacgtcgtacctacgtacgttcgacgtaccaacggtccgtcccttacccnccaacctacttccgtcggtcggtcctaccgtgacgtcggtaacggacgcgtcttagtactttacgactcgacgtctctacgtattaccgaactccaaccgtaccacctccgtagtaccgtcggtcggacggtaccgtaacgacgtccgttaccgtaccgttacggagttccgacccggacgtcggtcccgtacccgtccccg

SEQ ID NO: 42201 - DNA, 813 bp, Homo sapiens
  misc_feature: GYAE6OF02GPZ0I.52.75.G09.1.454.CMB.1.raw
  modified_base (242)..(242): a, c, t, g, unknown or other
  misc_feature (242)..(242): n is a, c, g, or t
  modified_base (670)..(670): a, c, t, g, unknown or other
  misc_feature (670)..(670): n is a, c, g, or t
tcagcgcagtacgacacgaccggtgctcgatttagtatagacatcagggggctggggtctcaggaggcagcgctctcgggacgtctccaccatggcctgggctctgctattcctcaccctctcactcgtgggcacgaggactcccgggccagtctcgccctgactcacgcctcgcctcgtgtccgtgggtcctccgtggactacgtccgactacaactctcctcgcgacctacggacgaacncgtacgtacggtacgtacttggttacggttaacgttaactaacgttcggtcgttcccgtaccggtaaccggtaaacccgaacccgaaacccccggaaccccggtaaaaccgaaacccccgttaacccctaatacgtaaggttaacgtttaacgttcgccgttcgttacttaaccgttaccggttcggccccggtaccgtaaggggttactttactccgtactccggttcctttcgttaccgtcgtacctacgtaacggtcgtaggtaacccgaccgtaacccgtcccgtaccccttaccgactaccttcgttccgggtcgtaacccggttcctacgtcgggttacgacgggaaaccgggtcgtcggttaacttagttaactttagtccggaactcggttaaccgtaccttaacgttaaacggtaaccncccgtaaaccctcctaaccggtttacctaacgttaacgttcggtccgggtacgggaaccgtaacggaacttaccggtcccgaacggttaccgtaaggacccgtaaccgaccgtccggtaacccttcccggtcccgttaacccg

SEQ ID NO: 42202 - DNA, 106 bp, Homo sapiens
  misc_feature: GYAE6OF01AP81C.42.82.H05.1.454.CMB.1.raw
  modified_base (106)..(106): a, c, t, g, unknown or other
  misc_feature (106)..(106): n is a, c, g, or t
tcagtgacgtatgtcacgaccggtgctcgatttagtcgagctctctcgcgggcacgaccggtgctcgatttagcagacgtctgagcgggctggcaaggcgcatagn

SEQ ID NO: 42203 - DNA, 139 bp, Homo sapiens
  misc_feature: GYAE6OF01BWDTV.42.82.H05.1.454.CMB.1.raw
  modified_base (139)..(139): a, c, t, g, unknown or other
  misc_feature (139)..(139): n is a, c, g, or t
tcagtgacgtatgtcacgaccggtgctcgatttagtcgagctctctcgcgggcacgaccggtgctcgatttagtacacgtgattagggattgggtgatagggtacgcactcgtctgagcgggctggcaaggcgcatagn

SEQ ID NO: 42204 - DNA, 122 bp, Homo sapiens
  misc_feature: GYAE6OF02I5TO7.42.82.H05.1.454.CMB.1.raw
  modified_base (117)..(122): a, c, t, g, unknown or other
  misc_feature (117)..(122): n is a, c, g, or t
tcagtgacgtatgtcacgaccggtgctcgatttagtcgagctctctcgcgggcgacgaccggtgctcgatttagctgcgtcacgatctctcctgagcgggctggcaaggcgcatagnnnnnn

SEQ ID NO: 42205 - DNA, 161 bp, Homo sapiens
  misc_feature: GYAE6OF02F9BY3.42.82.H05.1.454.CMB.1.raw
  modified_base (161)..(161): a, c, t, g, unknown or other
  misc_feature (161)..(161): n is a, c, g, or t
tcagtgacgtatgtcacgaccggtgctcgatttagtcgagctctctcgcgggagagctccccaaagaactgcgagatgtcactaaatcgagcaccggtcgtgctgcctggtcaaggactacttccacatacgtcactgagcgggctggcaaggcgcatagn

SEQ ID NO: 42206 - DNA, 160 bp, Homo sapiens
  misc_feature: GYAE6OF02HEZBW.42.82.H05.1.454.CMB.1.raw
  modified_base (160)..(160): a, c, t, g, unknown or other
  misc_feature (160)..(160): n is a, c, g, or t
tcagtgacgtatgtcacgaccggtgctcgatttagtcgagctctctcgcgggagagctcccaaagaactgcgagatgtcactaaatcgagcaccggtcgtgctgcctggtcaaggactacttccacatacgtcactgagcgggctggcaaggcgcatagn

SEQ ID NO: 42207 - DNA, 139 bp, Homo sapiens
  misc_feature: GYAE6OF02HBGH8.42.82.H05.1.454.CMB.1.raw
  modified_base (139)..(139): a, c, t, g, unknown or other
  misc_feature (139)..(139): n is a, c, g, or t
tcagtgacgtatgtcacgaccggtgctcgatttagtcgagctctctcgcgggcacgaccggtgctcgatttagatcgtctgtgttgggtttgggccggatccgagacgtatcactgagcgggctggcaaggcgcatagn

SEQ ID NO: 42208 - DNA, 128 bp, Homo sapiens
  misc_feature: GYAE6OF02GNP1I.42.82.H05.1.454.CMB.1.raw
  modified_base (117)..(128): a, c, t, g, unknown or other
  misc_feature (117)..(128): n is a, c, g, or t
tcagtgacgtatgtcacgaccggtgctcgatttagtcgagctctctcgcgggcgacgaccggtgctcgatttagctgcgtcacgatctctcctgagcgggctggcaaggcgcatagnnnnnnnnnnnn

SEQ ID NO: 42209 - DNA, 170 bp, Homo sapiens
  misc_feature: GYAE6OF02JPLBD.42.82.H05.1.454.CMB.1.raw
  modified_base (132)..(132): a, c, t, g, unknown or other
  misc_feature (132)..(132): n is a, c, g, or t
  modified_base (151)..(170): a, c, t, g, unknown or other
  misc_feature (151)..(170): n is a, c, g, or t
tcagtgacgtatgtcacgaccggtgctcgatttagtcgagctctctcgcgggcacgaccggtgctcgatttagtcgagctctctcgcgggcacgaccggtgctcgatttagtagtgtagattccacggcggngtcgagacggcactagagnnnnnnnnnnnnnnnnnnnn

SEQ ID NO: 42210 - DNA, 509 bp, Homo sapiens
  misc_feature: GYAE6OF01C9WHJ.52.46.E02.1.454.CMB.1.raw
  modified_base (318)..(318): a, c, t, g, unknown or other
  misc_feature (318)..(318): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtactataattctgtctctgtaccaacaatacccgcaaagtcccaactcatgatctttgaggtcaatgatcgcccgnaggggttctcatcgcttctccgctccaagtctgcagcacggcctcctgaccatctctgggctccagggctgaggacgaggctgattattactgcagctcaatatacaaacagaaacacgttgggtgttccggcggcgggaccaggactgaccgtcctacgtcacgcccaaggcctgccccctggtctaccc

SEQ ID NO: 42211 - DNA, 514 bp, Homo sapiens
  misc_feature: GYAE6OF01C4J8D.52.46.E02.1.454.CMB.1.raw
  modified_base (407)..(407): a, c, t, g, unknown or other
  misc_feature (407)..(407): n is a, c, g, or t
  modified_base (447)..(447): a, c, t, g, unknown or other
  misc_feature (447)..(447): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacaggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaacgtccccaaactcatgatctttgaggtcaatgatcggcccgcaggggtttctcatcgcttctccggctccaagtctggcagcacggcctccctgaccatctctggctcaggctgaggcgagntgattatctgcagctcatataacaacagaaacacttgggngttcggcggcggaccagactcgtaccgtcctacgcacgcccaaggcctacgcccctcggtctacccg

SEQ ID NO: 42212 - DNA, 557 bp, Homo sapiens
  misc_feature: GYAE6OF01EBC5P.52.46.E02.1.454.CMB.1.raw
  modified_base (325)..(325): a, c, t, g, unknown or other
  misc_feature (325)..(325): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataattctgtctctggtaccaacaatacccggcaaacgtccccaaactcatgatctttgaggtcaatgatcggcccgngacggggtttctcatcgcttctccggctccaagtctggcagcacggcctccctgaccatctctgggctccgaggtctggacggaccgaggcctggtatttattactcgcagctcaataactaacaaacaagaaactcgttggggtcgttcgggcgggccgggaccgaagtaccgtcggaccgttcctacggtcgacgaccccgaaggcctccgcccccgtcggtcctacccg

SEQ ID NO: 42213 - DNA, 561 bp, Homo sapiens
  misc_feature: GYAE6OF01BEUIR.52.46.E02.1.454.CMB.1.raw
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataattctgtctcctggtaccaacaactacccggcaaacgtccccaaactcatgatcttgagtnaatgatcggccgcgtaggggtttctcactcgtcttcgtccgctcaagtctggcaagcaccggcctcctgacctatctctcgggcctccgaggctggacggacgacggtctagtacttattactgctagctactagtaactacaaactacgaaactgttacgggtcgttcgggcggacgggtaccagaccgtacgacccgttccgtaccgtcgaacgacccgtacggccctacgcccccgtgtcctacccg

SEQ ID NO: 42214 - DNA, 563 bp, Homo sapiens
  misc_feature: GYAE6OF01AUPK9.52.46.E02.1.454.CMB.1.raw
  modified_base (230)..(230): a, c, t, g, unknown or other
  misc_feature (230)..(230): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataattctgtctcctggtacaacaataccccgacaaacgtccccaaactcatgatcttgaggtcaatgatcggcccgtcgaggggtttctcgatcgcttctccggtctccaagtctggcagccacggcctccctgacccatcctcgtacgggcctccgaggctcgagggacgaggctagtattagttactgcagctcagtaactacaaacgaagaaccttacgttgggtcgttacgggcgggccggaccgacggaaccgtcgtacccgtcctacggtccacggcccaacggcctacggccccctcggtcctacccg

SEQ ID NO: 42215 - DNA, 544 bp, Homo sapiens
  misc_feature: GYAE6OF01DNN2J.52.46.E02.1.454.CMB.1.raw
  modified_base (328)..(328): a, c, t, g, unknown or other
  misc_feature (328)..(328): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcaatgacgttgtactataattctgtctctgtaccaacaactacccggacaaacgtacccaactcatgatcttgagtcatgatcgccgcgtagggttcncatcgtcttcgtccggctccgaagtcgtgcaagccacggccctccctgacctatcctcgtcggctccgaggctggacggacggagctagtattatcngcacgctanaatactaacaaacgagaaactcgttgggtcgttcgggcggacggaccaggactcggacccgttcgtaccgtcaccgacccgacggtcctccgcccccgtcgtcctacccg

SEQ ID NO: 42216 - DNA, 551 bp, Homo sapiens
  misc_feature: GYAE6OF01BGJMC.52.46.E02.1.454.CMB.1.raw
  modified_base (283)..(283): a, c, t, g, unknown or other
  misc_feature (283)..(283): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgtttggtacttataattctgtctcctggtaccaacaatacccggnaaacgtccccaaactcatgatctttgaggtcaatgatcggcccgcgtagggttctcatcgcttctcggctaccaagtctggcagcacggcctccctgaccatctcgtcgggctcgagctagaggacgaggctagtatttaactagtcgctaagctacaataactaacgaaacgtaagaaactacgttcgggtgttaccgggcggacgggaccagtaccgtgtaccctcgtacgtcgacgacccaaggctaccgcccctggtctacccg

SEQ ID NO: 42217 - DNA, 700 bp, Homo sapiens
  misc_feature: GYAE6OF01CN86I.52.46.E02.1.454.CMB.1.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (548)..(548): a, c, t, g, unknown or other
  misc_feature (548)..(548): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacgacgggtcctgggcccagtctgccctgactcagcctgcctccgtgtcgtggtctccgtggacagtcgatcacctatctcctgcacgtggaaccngcaatgacgttgtacttataattctgttcnctaggtaccaactaacgtcccgganaaaccgcccaaactcatntacttcgtagtagcaatgtacgccgccgacgtggttactacngttccgtcttccgtccgggtcctaaccgtaacggtcgttacggaccgaacggtccccgtaccggtaccccccttaccgtacggaaccccttacgtcccgttccggtaccgggtaccctccggtaacggtacgttacgggaacgggtaaccggtacggtacgttagtacgtttacgtacctcggtactaagtccgtaanaaccttaaataaccgaaaacaacgtaaaccgtggtttacggttacggtccgggacggtaccggaaccgtacggaccgttacggacccgttacggcccttaccggacgtaccccgtcgtaccccgtccggtcccccttcggtacccgttcccg

SEQ ID NO: 42218 - DNA, 681 bp, Homo sapiens
  misc_feature: GYAE6OF01BSKOT.52.46.E02.1.454.CMB.1.raw
  modified_base (379)..(379): a, c, t, g, unknown or other
  misc_feature (379)..(379): n is a, c, g, or t
tcagcgcagtacgacacgaccggtgctcgatttagactcatctacagggaaagggggctgggggtctcagggaggcagcgctctcgggacgtctccaccatggcctgggctctgctattcctccaccctcctcactcgagggcacgagggtcctgggcccagtctgccctgactcacgcctgcctcgtgtcgtgggtcctccgtggacagtcgatccacctacttcctcctcgacctacgtacggaaccagactaagtggtacgttgtaacttataattctgtctcctacggtaaccaacaacgtaccccgacaaacgtaccccaaactcatcgattcgtttgagtacaatcgacgtccggcccgtagtacgggtttcncgtactcgtccttcgtccgctacacgtcgtggacacgccgaccggtcctccctacgacctacgttccgtcgtcgggcctccggcggtcgtacggaagggacggacggtacgtgttaacttacgttacgtgctacgctaacgtaactaactaaaccaaagtaacgtaaacgttacgggttcggggtacggttccggggacgggtaccggaccgtaagtaccgtaccggtacccgtaccgttaccggtacgaacccggacccgtaccgggtcccttccccggtccccggtcgtccgttaccccg

SEQ ID NO: 42219 - DNA, 806 bp, Homo sapiens
  misc_feature: GYAE6OF01BE7H3.52.46.E02.1.454.CMB.1.raw
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctcgtgtctcggggtctccgtggacaggtcgactccgaaccattcctccgtgccaaccgtacggaaacccaggacctaaagttcggtacggtttacggttaacctttaattaacgtttcctacggttccttacccgtaggtaaacccaaaccgtaaaccgtaacccccgggaactaaaacccggtaccccctaaaactcgtaattcggtacttccgtttaggtaacggttacctaaagttcggacgtaccgggcccgtacgggttaacggggtttccacgtacgtccgtccgtttaccgccggtcctaccgtaacggtccgtcggacacgtaccgaccggtcccctaccgtacgaccctcgtccgtcggtacgggtcctaccggtacggtcgtaacgggaccgggaacgtacggtccttaaggttaactttacgttaacgcgacgtacgtactaacgtaacgttaactaaaccgtaaaggtacccgtaaacggttcggttacggggtccggttaccggggacgggtaccggtaccaacgggttaaccgtccgttacccgggttaccgtaacggtacccgaacggtacccgtacggtcccgtacccggtacccgtcgggtcccttacccg

SEQ ID NO: 42220 - DNA, 765 bp, Homo sapiens
  misc_feature: GYAE6OF01CBCD6.52.46.E02.1.454.CMB.1.raw
  modified_base (228)..(228): a, c, t, g, unknown or other
  misc_feature (228)..(228): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcgagggcacgacgggtcctcgggccagtctcgccctgactcacgtcctgcctccggtgtcgtcgggtcctccgtggacctagtcgactccaaccntcctcgtgactacgtacggaaccagacctaagtggtaccgttaggttaacttattaacttctgtcctcgtacggtaacctaaccgtaaccgtaccccggaataaaccgtaccccaaattcaatcgtacttcgttagacggttacatcggacgtacccggtccggtcgttcgggttacactcgttccgtcttcgtaccgtacgtaccgtaggtcctggaccgtacggcccgtacccgtccccgttaccgtactacctacgttccgtacggtccgggtacctaccgggaggtaccgtagggtaacgggaccgtacggtacgttacgtatttaccgtaacgttcaaccgagtacctacgtaaacttaacctaaaccaaaaaccggttaagaacccggttacggtttacgggtacggttccgggaccgggtacccggaaaccggtcggtacccgtaccgtacccggttaccgtaccgtacccggtaaccgtacccggacccggtaccggcccccgttaacccgtccgtcccgttaccccgg

SEQ ID NO: 42221 - DNA, 818 bp, Homo sapiens
  misc_feature: GYAE6OF01BJ30C.52.46.E02.1.454.CMB.1.raw
  modified_base (193)..(193): a, c, t, g, unknown or other
  misc_feature (193)..(193): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctctcactcagggcacagggtcctgggcccagtctcgccctgactcagcctgcctccgtgtctgggtcnccgtggacaggtcatccaccatcctcctgcctacgtcggaaccagacagtcggtacgttggtaacttataacttctcgtcctccgtacggtaaccaactaaccgtaccccggacaaaccgtacccctaaatcctagtacgtacttcgttagtacgttactaagtcggtacgtccgggacccgtacggttacgggtttacctacgtacgttccgtcctttaccggtcccggtacctaccgtaacggttccgtcgggactacggtacccgtacccggtcccctttaccgacgtaaccctagttcccgtcggttaccggggtacctaccgggtacggtacggttaacgggaaccgggtaaccgggtacgggttacgttaaccggtttaaatttaccgttaacgtcccggtacgtaccgtaccgtaagttaaacctaacgtaaaccgaaaacgtaacgtaaaccggtttacgggttaccggggtaccgggtacgggtcccgggaccgggtaaaccgtaccgggttaccgttaccgggtaccccgtttacgggtaaccgtacccggtaacccggtacccggtaaacggttcccccgtacccgtcccccggttaccgtcccgttaccccgg

SEQ ID NO: 42222 - DNA, 744 bp, Homo sapiens
  misc_feature: GYAE6OF01B8LLB.52.46.E02.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (383)..(383): a, c, t, g, unknown or other
  misc_feature (383)..(383): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatccactntcctctnccactaggaaccagactaagttcggtacgttagttacttaattaactttctcgttcctccttacggtaaccctaacaacctaccccggactaaaccgtaccccctaaactcatgtacttcgtttggtagtactaatgactccggccgacgtacgggtttcncgtactccgtcttaccgtccgtcctaccgtaagtcgtcggcacgccgacccggtcctccccgtacgaccctacgttcctcggtaccggtcgtaccgcggtcgtaaggcggacgtacggtcgtagttaacgttacgttacgtcggacctacgtacctactaacgttaactaaaccaaacgtaacgtaaacgttaacgggttaggggttaccggtaccggggtaccgggtaccggtaccgtaaccgggttaaccggtaccggtaacccccgttaccgtacccggtccggaaacccggtaccccggtaaccgggttcccgtaccccggttacccccccggttaccgggttcccttaacccccgg

SEQ ID NO: 42223 - DNA, 831 bp, Homo sapiens
  misc_feature: GYAE6OF01D71U1.52.46.E02.1.454.CMB.1.raw
  modified_base (800)..(800): a, c, t, g, unknown or other
  misc_feature (800)..(800): n is a, c, g, or t
tcagcgcagtacgacacgaccggtgctcgatttagactcatctacagggaaagggggctggggtctcaggaggcagcgctctcgggacgtctccaccatggcctggctctgctattcctcaccctctcactcagggcacaggtcctgggccagtctgccctgactcagcctgcctcgtgtctggtctcctggacagtcgatcaccatcctcctgcacgtcggaaccagcaaagtgacggtttaggtacttataattctgtctccttggtaacccaaacaaccgtaccccggtacaaaacgttacccccaaacttcatagtattacgtttaggaacggttacctaagtcgacgttccggaccccgtacgggttacggggtttacctcgtacgtaccggtcgtttcccgtacccgggtcttaccctaacggtacctagggacctacggacccgtacccgggtccccttaaccccgtacgtaaacccgtcgtttaccgtcccggttccgggggtacccttacccgggtaaggggttcccgttaacggggaaaccggggttaaccggaacccgggttacgttaacggtttaacttttaaacgtttaccggttacgaaccggttaacggtaccttaacgttaaacgttaaacgtaaaccgaaaaaacgttaaccggtaaaacttccgggttttacgggggacgggtttaacccgggaaccgggtaccgggtaccgtaaacggttacccggttacggtaccccgttaccgtaccgttacccgaacccggtacccgtaacggtcccnccccggtacccccgtacggtccttaacccgg

SEQ ID NO: 42224 - DNA, 674 bp, Homo sapiens
  misc_feature: GYAE6OF01CCF4G.52.46.E02.1.454.CMB.1.raw
  modified_base (231)..(231): a, c, t, g, unknown or other
  misc_feature (231)..(231): n is a, c, g, or t
  modified_base (340)..(340): a, c, t, g, unknown or other
  misc_feature (340)..(340): n is a, c, g, or t
  modified_base (479)..(479): a, c, t, g, unknown or other
  misc_feature (479)..(479): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcatcaccatctcctgcacgtggaaccngacaatgtacgttgtacttataattctgtctcctggtacaacaactaccccggacaaacgtccccaaactcatgtattctttagacgtacaagtgacgtccggacccgngtacgggtttctcgtactcgcttccgtccgctaccgaagtctcggcacgccgtaccggccctacccgtcgacccacttccgtcgtcgggcctaccgaggtccgtaggacggacggcgtcgtaggttacttaacgttcgngcctacgctaactaattaacctaaacgaaacctaacgtaaaaaccttccgggtttaggggttcggttacccggggtacggggacccgggttaaccgaacggtacccgttacggtacccccggttaccggtaccgtaccccgacggaacccgtaacggccccgttcccggtaccccccgtggtccccgttaacccg

SEQ ID NO: 42225 - DNA, 936 bp, Homo sapiens
  misc_feature: GYAE6OF01A8TPC.52.46.E02.1.454.CMB.1.raw
tcagcgcagtacgacacgaccggtgctcgatttagactcatctacagggaaagggggctgggggtctcaggaggcagcgctctcgggacgtctccaccatggcctgggctctgctattcctcaccctcctcactcagggcacgagggtcctgggcccagtctcgccctgactcagcctgcctccgtgttcgtgggtcctccgtggactaggtcgactcacctattcctccctagacctacgtacggaaacctaggaccaagtggtaccggtttacggtaactttattaacgtttccttacggttcccttacccgttaacgggtaaccctaaaaccgtaaacccgtacccccggaaacctaaacccggttaacccccctaaaaccgtaccgtaacgttacgtaccgttttacggtttaacggtaaccggttaaccgtaaacgttacgggtaaccgttaccccggggtacccccggttaacgggttaccgggggtttttacctacccgttaaccggtttcccggttccccgttttacccgggttccccgggtacccttaaccccggtaaacgggtttcccggtacggggtaacccgtaccgggtaccccggtaaccccgggttcccccttacccccgtaccggtaaccccgtacggtttcccggttccgtaccgggtaccccggtaccgtacgggtacgtacgggaacgggtaccggtacggtcgttaacgttaacttacgtcgtagacgtacgacctacgtaactaacggtaacctaaacggtaacgtaacgttacggttacgggtcgggtaccgggaccgggtaccggtaaccgtaccggtacccggtacccgttacccggtaccggtacccggtcgaaccccggtaaccggtccgaccccggttaccccgtcccgttccggtaccgttacccccg

SEQ ID NO: 42226 - DNA, 697 bp, Homo sapiens
  misc_feature: GYAE6OF01B3D03.52.46.E02.1.454.CMB.1.raw
  modified_base (201)..(201): a, c, t, g, unknown or other
  misc_feature (201)..(201): n is a, c, g, or t
  modified_base (523)..(523): a, c, t, g, unknown or other
  misc_feature (523)..(523): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctctcactcagggcacagggtcctgggcccagtctgccctgactcagcctgcctccgtgtctgggtctccgtggacngtcgactcacctatctcctgcactcggaaccagcaatgacgttggtacttataattctagtctcctcggtaaccaacaacgtaccccgacaaacgtccccaactcatgattcttagaggtctaagtgacgtccggacccgtcgtaggggtttcctactagtcgtccttccgtccgtctacccgtaaggtccgtcggtacacggccgtaacccggtcccctcccgtacggtacccttacttcccgttcggtcgggcctaccgtacggggaccgtacgggtacggaacggtacggtctaggttactttagtaccgtcgtacgtntacctataactaacaaacaacgttaacgaacgttcgggttacgggttacggtcgggtaaccggaccgggtaacgaaccggtaccgttcgtaaccggttaccgtacggtacggaccccgtacccgggtacgtaccccggttaccccgccccggttaaccggttcccttaccccgg

SEQ ID NO: 42227 - DNA, 678 bp, Homo sapiens
  misc_feature: GYAE6OF01DURIX.52.46.E02.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
tcagcgcagtacgacacgaccggtgctcgatttagactcatctacagggaaagggggctgggggtctcaggaggcagcgctctcgggacgtctccaccatggcctgggctctgctattcctcaccctcctcactcagggcacagggtcctgggcccagtctcgccctgactcagcctgcctcgtgtctggtctctggacngtcgatcacntcctctgcactggaaccagcaatgacgttgtacttatattctntctcgtagtaccaacaactacccggacaaacgtcccaaacgtcatagtacttcgtttaggacggtacaagtgacgtccggtaccgtcggtacgggtttctcacgttccgtccgttccgtccggtcctaccgtacggttccgtacggaccgtacgaccgtacccggtccctcccgtacgtacctacgtccgtcggtcgggtacctcggtacgggtcgtacggaacggacgtacggtacttagttacttacttacggtcgccgtagtcctaactaacgttaacaaccgaaacgtaacgtaaacgttcggttacgggtcggtccgggaccggtcggaaccgtacggtaccgttcggaacccgttaccgtaccggtaccgaccggtacccgtaacgtcccgtacccggtcccgtcgggtactaccccgg

SEQ ID NO: 42228 - DNA, 745 bp, Homo sapiens
  misc_feature: GYAE6OF01AIZ8L.52.46.E02.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctctcactcgagggcacgagggtcctgggcccagtctgccctgactcacgcctgcctcgtgtcgtgggtctccgtggacngtcgatccaccntctctgcacgtacggaaccngactaatcggacgttgtacttatattcgtcgtctccgtacgtaaccaaccgtaaccgtaccccggacaaaccgttcccccaaaattcctaagtcgtacttcgttaggacgttacaagttcgacgtcccgggacccgtcggttacgggtttccacgtacgttccgtcctttcccggtaccggtcctaccgtaacggtccggtacggcctaccgtacccgtacccggtcccctccgtaaccgtaacctccgttaccgtcgggtccgtccgtaccgtacgggtcgtacgggaacggtaccggtacggtcttaacgttaactttacccgttacgcgtaacgaccgttacgtaaccttaagtaaaacccaaccggtaaaactaacgtaaccggttacggttcggggtaccggtccgggaaccgggtccgaacgtacgtaccggtaccgtaccggtacctcggaccgaccgtaacccggcggttacccacccggttccggtaccgtcctacccgg

SEQ ID NO: 42229 - DNA, 682 bp, Homo sapiens
  misc_feature: GYAE6OF01A8H08.52.46.E02.1.454.CMB.1.raw
  modified_base (217)..(217): a, c, t, g, unknown or other
  misc_feature (217)..(217): n is a, c, g, or t
tcagcgcagtacgacacgaccggtgctcgatttagactcatctacaggggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgactccgaccntccgtcctgctactggaaccagcaagtgacgttgtacttataacttctcgtctcctacggtaccaactactacccggacaaccgtccccaactcatgattcgttagagtacaatgacgtcggccgtctagggttctcgacgtcgtcgttccgtccggtactaccgtaagtcgtcggtacgacgccgtaccgtcccgtacccgtacgtacctacttcgtcgtcgggcctcgaaccgggtcgtacggacggtacggtaggtcgtagtaattacgttatccggactaccggcttacgaactaacgaacgaaacgtaacgtaaacgtacgggtttacggttacgggttaccggaccggggtaaccgggaccgtaacggtaccggttacgtaacccggttcggtaacggtacccgacggaacccccggtaaggtaccccgccccggtccccctagggttacccctcccgg

SEQ ID NO: 42230 - DNA, 881 bp, Homo sapiens
  misc_feature: GYAE6OF01A0EQ4.52.46.E02.1.454.CMB.1.raw
  modified_base (122)..(122): a, c, t, g, unknown or other
  misc_feature (122)..(122): n is a, c, g, or t
  modified_base (129)..(129): a, c, t, g, unknown or other
  misc_feature (129)..(129): n is a, c, g, or t
  modified_base (532)..(532): a, c, t, g, unknown or other
  misc_feature (532)..(532): n is a, c, g, or t
tcagcgcagtacgacacgaccggtgctcgatttagactcatctacagggaaagggggctggggtctcaggaggcagcgctctcgggacgtctccaccatggcctgggctctgctattcctcnccctccncactcagggcacgagggtcctgggcccagtctcgccctgactcacgcctcgcctccgtgtcgtgggtcctccgtagactagtcgatccacacttccgtcctcgctacgtacggaaccagacaagtcggtacgttttacggttaaaccttaagttaactttcgtacgttacccgttaccccggttacgggttaaaccctaaaacccgtaaaccggttaaccccccggtaaaccgttaaaaaccccggttaaccccccctaaaaccttacgaactttaccggtacttttaccgtttacgggtacggttactaaagttaccggacgttaccccgggcccgtacggttaaccggggttcctacgtaccgtcgtcccgttcccgtccgggtcttaccggtaactccgnggtccaacggtcccgtacccggtaccttcccgaacgacttccgtcccgttcggtccgggtccctacggtcggtaccgtacgggacgggtacgggaacggtccgttaagtttaccttttaacgtaccggtataacccggtattaacccgtataaacgggtaacccttaaaacggaaacctaaaaccggttaaccgttaccgggggttaggttacccgggttaccggggaccgggttaccgggaagtaacccgggaacgttccggtaaccccgttacccgggtctacccgggaacccttacccggaacgggtccccttccccgggaccctttcccgggtaccccttcccgg

SEQ ID NO: 42231 - DNA, 758 bp, Homo sapiens
  misc_feature: GYAE6OF01C9J2O.52.46.E02.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
tcagcgcagtacgacacgaccggtgctcgatttagactcatctacagggaaagggggctgggtctcaggaggcagcgctctcgggacgtctccaccatggcctggctctgctacttcctcaccctcctcactcgagggcacgacgggtcctgggcccagtcctcgaccctgactcacgcctcgcctcgtgtcgtgggtctccgtggacngtcgacnccaccgatccgtcctgccacgtacgaaccagacaagttcggtacgtttcgttaacttattaacttcgtacgtccgtccgtaacgtaaccaaaccaaccgtaccccggaactaaaccgtaccccaaactcactaggtacttacgttaggagtactaagtggaccgccggtcccgtagttacgggttctcacgttccggtcttcccgtccgtacctaccgtacgtcgtacggactaccggaccgtacccgttcccgtaccgtaccggacccttacgttccgttccgggtaccgggtaccttaccgggacggtacggtaggaacgggacggtacgtacgttaacgttaacgtttacgttaccgtacgacgtacttaccgtaacgtaaactaacgaaactaaaccggtaacggtaccgttacgggtttacggggtccgttaccggggaccgggtaccggtaaccgtaggtaccccgtacggtaccccgttaggtacccgtacgacccgccggtacgtcccgtacccgtcccgtacggtacccttcg

SEQ ID NO: 42232 - DNA, 723 bp, Homo sapiens
  misc_feature: GYAE6OF01AZ22B.52.46.E02.1.454.CMB.1.raw
  modified_base (291)..(291): a, c, t, g, unknown or other
  misc_feature (291)..(291): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccatctcctcgcactggaacctagacaatggacgttgtacttataattctgtctccgtggtaccaacaacgtaccccgganaaaccgtccccaaactcatcgatcttgaggtcaatcggacgtccggacccgtcgtagggtttactcgtactccgtcttccgcccgtctacgaagtccgtcggctagcccgtaccggcccttacccgtcgtaccctacgttccgttccggtcgggtaccgttcccggtacggtaccgttacgggaaccgggtaacggtacgggtacgtacgttacgtttaaacgtttacgtcggtacacgtacctacgtaacttaacaaaccgaaactaaacggtaaacttacgggttttggggtaccggttaccggggtcggggaccgggtaaccgacgggtaaccgttccgggtaaccccgttccgttaacccggttacgaaccccggaccggtaaaccggtcccgtaccccggtccccccttcgggttaccctaccccgg

SEQ ID NO: 42233 - DNA, 524 bp, Homo sapiens
  misc_feature: GYAE6OF02GI286.52.46.E02.1.454.CMB.1.raw
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatcttgaggtcaatgatcggcccgcgagggtttctcatcgcttctccggctcagtctggcagcacggcctccctcgaccatctcgtgggcctccgaggcctgacggacgaggctgacttattactgcagctcatatacaaacagaacacgttgggtcgttcgggcgcgggacagacgtcgaccgtcctcgtcacgccgacgccgtccgcccctcggtctaccg

SEQ ID NO: 42234 - DNA, 532 bp, Homo sapiens
  misc_feature: GYAE6OF02H39FB.52.46.E02.1.454.CMB.1.raw
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtacaacaataccccggcaaagtccccaaactcaatgatctttgaggtcaatgatcggccgnagggtttcncatcgcttctcgctccaagtctggcagcacggcctccctcgacccatctctcggctcaggctgaggacgaggctgatttattactgcagctctatttacaagccaccaccacctcctgtaactcgttaccggcgggacggaccgaagccgtacgtacccgtcgtacggtcacggcccgaaggccgtcgccccctcgg

SEQ ID NO: 42235 - DNA, 698 bp, Homo sapiens
  misc_feature: GYAE6OF02IYD8G.52.46.E02.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccngcaatgacgttgtactatattctgtctctgtaccaacaactacccggcaaagtccccaaactcatgatcttagaggtnaatgactcggcccgngtacgggtttctcatcgcttctccggctccaagtctggcagcacggtcctaccgtgacctactctacgtcgggtctacccgaggtctacgggacggaccggtaagggtccgttaggaacttttaagttaaccgtcgggtaccttaacgggccctttacgaaacctttaaacttaaacccgaaaaaccgtaaacggttaaaaacccgtacgttttaaccgggggtacggtttacccggggtacggggtacccggggtaccgtaaccggtaaccggttaccggtaacccggttacccgtttaaccggacccgtaaaccgggtccccaaacgggttcccgttacccggtccccccggttacccggtaccgttaccccgg

SEQ ID NO: 42236 - DNA, 768 bp, Homo sapiens
  misc_feature: GYAE6OF02G667H.52.46.E02.1.454.CMB.1.raw
  modified_base (229)..(229): a, c, t, g, unknown or other
  misc_feature (229)..(229): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactgaaccngacaatgacgttgtacttataattctgtctcctggtaaccaactaacgtaccccgactaaacgtaccccaaactcatagacttcgtttaggacggttacaagtcgtaacgtccggccccgtcggtaacggggttttcctccgaagttccgtcctttccgtccggtcctacccgtaagttcgtacggcgtacggccgacccggtccctacccgtacggaccctactcccgttccgtcggggtccctccggaacggtccgtagggaacgggtaccggtaacgggtcttaagtaacttttaacgtttaccgtcgtaccgtacgtccttacgaaacttaaacttaaaccgaaaaacgtaaaccgtaaaaacgttccgggttttaacgggggttcggtttacccgggggccgggtaccggggaacccgtaacggtaacccggttccggtaaccccgttaccgtaacccggtaccgaccggtaaccccggtaaccgggttcccgtcccccggtacccccggtttacccggtacccttaaccccgg

SEQ ID NO: 42237 - DNA, 556 bp, Homo sapiens
  misc_feature: GYAE6OF02FUNAQ.52.46.E02.1.454.CMB.1.raw
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaacgtccccaaactcatgatctttgaggtcaatgatcggcccgcaggggtttctcatcgcttctccggctccaagtctggcagcacggcctccctgacccatcctcgtcgggcctccgaggtctggagggaccgagggcctggtattattactgcagctcatataacaaacaagaactacgttggtcgttcggcggcggaccaggacgttcggacccgttccgtaccgtacgaccgcccgaacggcctacggccccctcggtaccctacccg

SEQ ID NO: 42238 - DNA, 576 bp, Homo sapiens
  misc_feature: GYAE6OF02IZBE1.52.46.E02.1.454.CMB.1.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (331)..(331): a, c, t, g, unknown or other
  misc_feature (331)..(331): n is a, c, g, or t
  modified_base (387)..(387): a, c, t, g, unknown or other
  misc_feature (387)..(387): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccgatctcctgcactggaaccngcaatgacgttgtacttataattctgtctcctggtaccaacaactaccccggnaaacgtccccaaactcatgatctttgacggtcaagtgatcggcccgngtaggggtttctcatcgcttctccggctcgaagtctggcagcacgcctcctgaccntctcgtcggctccgaggctgacggacgaggctagtattactactgcagctacatactaacaaacaagtaaacctcgtttagggtcggttacggcgggtacggaccgtaggtaccgtcggtaacccgtcgtaaccggtccgaaccgtacccgtaacggtcccgtaccgcccccggttaggtccctacccg

SEQ ID NO: 42239 - DNA, 734 bp, Homo sapiens
  misc_feature: GYAE6OF02I3PO0.52.46.E02.1.454.CMB.1.raw
  modified_base (230)..(230): a, c, t, g, unknown or other
  misc_feature (230)..(230): n is a, c, g, or t
  modified_base (366)..(366): a, c, t, g, unknown or other
  misc_feature (366)..(366): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactcggaaccngcagtgactagttggtcgttaataactatcgtctcctcggtaccgacaaccaccccggacaaacgcccccaaactcaagtcgtaattttatgctgtacctacttacgtccggacccgcgtaaggggtacttttccnccgtaacttccgtactttccgtcccggtccttacccgaagttcctcggcacggccaccggtcccttcccgtcgtaccctattcctcggtcgggtcctacccgagggtcttacgggacgggtaaccgggacggtcgttacggttaagttttaccgtttaacgtccggacgtaccgttcgtaccgtaaacgtaacccaaactaaaacgaacgtaaaaccgttcggttttacggggttccgggttaaccggggccgggtaaccgggtaaccctaaaccggtttaccggaacccggtttaccctttccggtaccgtaaccggtaccccgtaacgggcccgttaccccggtccccccgttacgggttaccccg

SEQ ID NO: 42240 - DNA, 723 bp, Homo sapiens
  misc_feature: GYAE6OF02GC587.52.46.E02.1.454.CMB.1.raw
  modified_base (227)..(227): a, c, t, g, unknown or other
  misc_feature (227)..(227): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcactggaaccngcaatgacgttgtacttataattctgtctctgtaccaacactacccggacaaacgtcccaactcatgattcgttgaggtcaagtcgacgtccggacccgtcgtaacggggtttctacgtacgttcggtcctttccgtcccggtacctacccgtaacgttccgtacggcgaacggcccgtaccgggtccccttcccgtacgtaacccgtacttcccgtccggttcgggtccttacccggtagggtccgttacgggaacggggtaaccggacgggtacgttacggttaactttaacgtttaccgtacgcgtacgtccttactaagtaacttaaccgaaacgtaaacggtaaacgttaccgtttacgggttacgggttccggggaccgggtacccggggtaccgaccggtaccggtaccggtacccgttaccgtaccggtaccgacggtacccgaaccggtaccgtccccggtaccccgttcgggtaccttaaccccgg

SEQ ID NO: 42241 - DNA, 616 bp, Homo sapiens
  misc_feature: GYAE6OF02F0U9B.52.46.E02.1.454.CMB.1.raw
  modified_base (345)..(345): a, c, t, g, unknown or other
  misc_feature (345)..(345): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataattctgtctcctggtaccaacaataccccggcaaacgtccccaaactcatgatctttagaggtcaatgatcggccgcagggttctcatcgcttcncggctccaagtctggcagcacggcctcctcgacctatctactgggctccgaggcgtgacggacgaggctggtaattagttactgacagtcctcataataaccaaaacaacgtaaaccgttacgttaggggttacgtttcgggaccgggtaccgggtaaccaacggtaaccgtacggaccccgtttacccggttaaaccgttccgtaacccggtaccccgtaaagggccccgttaacccggcccccccggtttaccgggtcccttaacccgg

SEQ ID NO: 42242 - DNA, 645 bp, Homo sapiens
  misc_feature: GYAE6OF02I1N3C.52.46.E02.1.454.CMB.1.raw
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacgagggtcctgggcccagtctgccctgactcagcctgcctccgtgtctgggtcctcctggacagtcgatcaccatctcctgcactggaaccagcaatgacgttgtacttatattctgtctctgtaccaacactaccccgganaaacgccccaaactcatgtattctttggacgtacaagtgaactccgggcccgtagtagggtttccnctacgttccgtcctttccgtccgtcctaccgtaagttcgtcggcacgcccgtacggtcccctcccgtacgtaccctattccgtcggtcgggtcctaccgacgggtctagggacggtacggacggtacgtagttaatttagttacgtacgtacgacgtacctactaacgtaactaaaccgaaaacaaacgtaaacgtacggttgggttacggtcgggaccggtaccggacgacgtacggtacgacccggttactaccgtaccgacgtaccgacgccgtaccgccccgtgtaccctccg

SEQ ID NO: 42243 - DNA, 618 bp, Homo sapiens
  misc_feature: GYAE6OF02GN6JG.52.46.E02.1.454.CMB.1.raw
  modified_base (230)..(230): a, c, t, g, unknown or other
  misc_feature (230)..(230): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataattctgtctctggtaccaacaataccccggcaaacgtccccaaactcatgtatcctttgaggtcaagtgacgtcggccccgcgacggggttttctcactcgtcttctccggctccgaagtcttggcagccacggccctcctcgaccatcctcgtggcctcgaggcctggaagggaccgaggtctagtattagttactgacaggtctactaagtataaccgaaacgaagaaaccgttaacggttggtacggttccgggaccgggtaccgggaaccgacgtaccggtacggtacccgttacccgtaccggttaccgaacggaccccgaacggtcccgtacccggtccccgtaccgggtaccttaccccgg

SEQ ID NO: 42244 - DNA, 583 bp, Homo sapiens
  misc_feature: GYAE6OF02F1VZN.52.46.E02.1.454.CMB.1.raw
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (399)..(399): a, c, t, g, unknown or other
  misc_feature (399)..(399): n is a, c, g, or t
tcagcgcagtacgacacgaccggtgctcgatttagactcatctacagggaaaggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcaatgacgttggtacttataattctgtctcctggtaccaacaataccccggnaaacgtccccaaactcatgatctttgaggtcaatgatccggccgngtagggtttctnatcgcttctccgctccagtctgcagcacgtccctccgtcgacctatcctcgtcgggtcnccgagctgacggtacgagctgtattatctgctacgctactagtaactaacaaaccaagaactacgtttgggtacgttaccgggcgggaccgggacaacggtacctacggtacccgttacccgtaacgtccgaacggaccccgaacggtccctcccggtcccccgttaccgggtcttaaccccgg

SEQ ID NO: 42245 - DNA, 706 bp, Homo sapiens
  misc_feature: GYAE6OF02IRKNB.52.46.E02.1.454.CMB.1.raw
  modified_base (302)..(302): a, c, t, g, unknown or other
  misc_feature (302)..(302): n is a, c, g, or t
tcagcgcagtacgacacgaccggtgctcgatttagactcatctacagggaaagggggctggggtctcaggaggcagcgctctcgggacgtctccaccatggcctgggctctgctattccctcaccctcctcactcagggcacagggtcctgggcccagtctgccctgactcagcctgcctccgtgtctgggtctctggacagtcgatcaccatctcctgcactggaaccagcaatgacgttgtacttataattctgtctctggtaccaacaactacccggacaaacgtaccccaaactcatntacttctttagaggtacaatgacgtccggcccggtacgttaggggtttctacgtactcgtcctttccgtccggtctaccgtaacgttcgtcgggacaacggtccgaacccggtcccctccccgtacgtaccctacgtttcccgtcgtcgggccttacccggacggtacgttagggacgggaaccggacggtctagtatttactacgtgtctacgtcctataactaactaacaaacgtaacgtaaaccgtcgtttacggggtacggttaccggggaccgggtaccgggaaccgtacggtaccggtacgggttaccccgttaccggtaaccgtacccggtaaccggaccccggtaacgggtccccgttaccccggtaccccggttaccccgggtaccttaccccgg

SEQ ID NO: 42246 - DNA, 634 bp, Homo sapiens
  misc_feature: GYAE6OF02HPG5E.52.46.E02.1.454.CMB.1.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctagcactggaaccagcaatgacgttggtacttataattctgtctctgaccaacaataccccggacaaacgtccccaaaactcactgatctttgaggtcaatgatccggccgntagggttctnactcgcttcnccggctccaagtctgcatcacgcctcctcgaccatcnctcggctccgaggctaggacggacgtacggctagtatttataacgtcgactagtacctacgaacttaacttaaaccaaaactaaacgtaaaaccgtacggttttacggggtaacggtttccgggacggggtacccgggtaacccgaaggttaacgtaaccgggtaccccgttaaccgtaaccggttacccgaacggtacccccaagggtccccttacccggacccccggttacggtacccgttaacccg

SEQ ID NO: 42247 - DNA, 662 bp, Homo sapiens
  misc_feature: GYAE6OF02IZRJ4.52.46.E02.1.454.CMB.1.raw
  modified_base (232)..(232): a, c, t, g, unknown or other
  misc_feature (232)..(232): n is a, c, g, or t
tcagcgcagtacgacacgaccggtgctcgatttagactcatctacagggaaagggggctggggtctcaggaggcagcgctctcgggacgtctccaccatggccttggctctgctattcctcaccctcctcactcagggcacagggtcctgggcccagtctgccctgactcagcctgcctcgtgtctgggtctcctggacagtcgatcaccatcctcctgccacgtggaaccngacaagtgtacgttggtacttaataattctgtctcctacgttaccaacaactaccccgcaaacgtcccaaactcatgatcttgaggtcagtgactcggcccgaggtcgggtttctcacttcgtccttccgtccggtctcctaacgtcgcggtcagccgaccggtccctccgtcgtacctagtcctacgtcggcctcgcggtcgtgacggacgtaggcgtagtactttagttactcgactcgtactactaagtaacctaaacgaaacgaacgtaacgtacggtttagggttcggttaccgggtacgggtaccgggaaccgtaacggtacccggtacccggttaacccgttaacccggtaccgtaaccggtaacccggacggttccccgtacccggtaccccccggttacggtaccctaccggtttccccgg

SEQ ID NO: 42248 - DNA, 774 bp, Homo sapiens
  misc_feature: GYAE6OF02FL75G.52.46.E02.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatcctctgcactggaaccngcaatgtacgttgtacttataattcngtctcctggtaaccaactaactacccccgggactaaacgtcccccaaacgtccagtcgtacttcgtttaggaacgtctaagtgtaacgtccgggcccgtcgttaacgggggttttcctaccgtaacgttccggttccctttacccggttcccgggtacccgttacccgtaaacggtttcccgttacgggtaccgtaacggtcccgggtaacccgggttccccctttaccccggttacgtaaccctaacgtttcccggtttaccggttacggggtaccccttacccgggtacgggtccggttcgggaaaccggggtacggtacggtccgttaaggttacttttacgttacgtcgacgtacgttcgacttataacgttaaccgaaaccgtaaggtaaccgttcgggtttacggttacgggttccgggacggtaccgggacctggtaccggtccgacccggttaccgtaccgtacgaccgtacccgaggtacccgtcccggacccggttcgaccgtttcccg

SEQ ID NO: 42249 - DNA, 686 bp, Homo sapiens
  misc_feature: GYAE6OF02GAV2F.52.46.E02.1.454.CMB.1.raw
tcagcgcagtacgacacgaccggtgctcgatttagactcatctacaggggaaagggggctggggtctcaggaggcagcgctctcgggacgtctccaccatggcctgggctctgctattcctcaccctcctcactcagggcacgagggtcctgggcccagtctgccctgactcagcctgcctcgtgtctggtcctctggacagtcgatcacctatcctcctagcacgtcggaaccagcaatggtacgtttgtacttatattctgtcctcgtacgtaaccaacaactaccccggacaaacgtaccccaaactcatgtattcgtttaggacgtacaagtagtaccgtccggacccgtcggttacggggtttcctcctacgtccgtcctttccgtcccgactccgtaacgtcgtcggtacgaccgtcccgtaccgggtccctcccgtacgtaaccctacgttccgtccggtacggtccgtccggtaggtccgtacggacggtacggtacggtcttaggtaactttcgttaactcgactacgtcgtactattaactaactaaacgtaacgtaacgttacgttcgggttacgttaccggggccggtacggaccgacgtaccggtacgtaccggtcctaaccgtccgaccgtcccgaacggtcccgtcccgtccccgtacggtccttaacccg

SEQ ID NO: 42250 - DNA, 689 bp, Homo sapiens
  misc_feature: GYAE6OF02HCHA9.52.46.E02.1.454.CMB.1.raw
  modified_base (161)..(161): a, c, t, g, unknown or other
  misc_feature (161)..(161): n is a, c, g, or t
  modified_base (235)..(235): a, c, t, g, unknown or other
  misc_feature (235)..(235): n is a, c, g, or t
tcagcgcagtacgacacgaccggtgctcgatttagactcatctacagggaaagggggctggggtctcaggaggcagcgctctcgggacgtctccaccatggcctgggctctgctattccctcaccctcctcactcagggcacagggtcctgggcccagtcngccctgactcagcctgcctccgtgtctgggtctccgtggacagtcgatcaccatcctcctgccactcggaaccngcaaatgtacgttggtacttataattctgtctctgtaccaacaactacccggacaacgtaccccaaactcatgtattcttgacgtcaatgactcggcccgtacgtagggttctctagtcgtccttcgccgtctaccgaacgtctcggcgtacgtccgaccggccctcccgtacgacctacttccgtacgtccgggcctaccgcggtcgtaggaacgggtacgacggtcctagttacttaagttaccgcgtacgtacgtcctaactaacgttaaacctaacgaaaacgtaaacgtaaacccgttcgggtttaacggggttaccgggtccgggtaacccggggtacggaacccggaagttacccggtaacggtaccccggttcctaaccggtccaacccgggtaccgtaaccggtcccgtccccggtacccccggttaccggtacccttaccccgg

SEQ ID NO: 42251 - DNA, 711 bp, Homo sapiens
  misc_feature: GYAE6OF02FNMPD.52.46.E02.1.454.CMB.1.raw
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctcgggtctccgtgacagtcgatcaccgatctacctgcactcggaaccagcaagtcgaccgttgtaacttataattctagtctccgtaggtaaccaanaacgtacccgacaaacgtccccaaactcangatcttgcgtnagtnancgtcncgtaggttctcatctctcgtccgtctacacgtcgtacggcacgcgtaccggccttacccgtgaccacgttccgtacggtcgggtacctccggacggtaccgttagggaaccgggtaaccgtacgggtacttacggtaacttttacgtaccgttaggacctaacggtccttaacaaacgtttaacgtaaaccgaaaaaccgtaaacggtaaacccgtttaacgggttacggggtttaacgggttaccgggtaccgggtacccggggtaaccacggtaaccgttaccggtaccccggttacccgtaaccggttacgaacccggtaaccctacggggcccctttaccccgggccccgttaccgggtacccttaccccgg

SEQ ID NO: 42252 - DNA, 889 bp, Homo sapiens
  misc_feature: GYAE6OF02H3TGM.52.46.E02.1.454.CMB.1.raw
  modified_base (203)..(203): a, c, t, g, unknown or other
  misc_feature (203)..(203): n is a, c, g, or t
tcagcgcagtacgacacgaccggtgctcgatttagactcatctacaggggaaagggggctggggtctcaggaggcagcgctctcgggacgtctccaccatggcctggctctgctattcctcaccctcctcactcaggcacagggtcctcgggcccagtctcgccctgactcagcctgcctccgtgtctgggtctcgtcggacngtcgactaccacctatcctacctcgacctaacgtacggaaaccacgaccaagttacggtaacgtttacggttaacttaagtttaaacgtttccttacgttccttacccgtacggttaaacccaaaaccgtaaaaccgttaacccccggaaccgtaaaaccgtaacccccctaaaaacctacctaacgtacgtaactttacgttttacggtacggttaaccgaaagttaccggaacggtacccggtaccccgtacgggttaacggggtttaccttaaccgaacgtccgttaccgtttccccgttaccgggttacccgtaccgttaaccgttcgtacgggaaccgagtacccgtacccggttccccgttacccgtacgtaaccctacgttcccgttaccgtcgggttacccctacggaacggtaccggttacggaccggtaaccggtagtaccgttacggttaacttttaacgttaaccgtaccgtaccgtaacgtaccctaagtaacgttaaaactaacgaaaaccgtaaccgtaaaccgttaaccgggtttaggggttaccggttaccggggtaccgggaccgggtaaccgtacgtaccggtacggtaacccgtaccgtaaccggtcccaacggtaccggtaacggtcccgttacccggtacccccggtacgtacccgtaacccgg

SEQ ID NO: 42253 - DNA, 719 bp, Homo sapiens
  misc_feature: GYAE6OF02HGO5U.52.46.E02.1.454.CMB.1.raw
  modified_base (242)..(242): a, c, t, g, unknown or other
  misc_feature (242)..(242): n is a, c, g, or t
tcagcgcagtacgacacgaccggtgctcgatttagactcatctacagggaaagggggctggggtctcaggaggcagcgctctcgggacgtctccaccatggcctgggctctgctattcctcaccctcctcactcagggcacgagggtcctgggcccagtctcgccctgactcagcctgcctcgtgtcgtcgggtctccgtggacagtcgatccaaccatcctcctgacctacgtcggaaccngacaagtcggtacggttggtaacttatacttctcgtcctcgtacgtaaccaactaccgtacccgactaaccgtaccctaactctacgtacgtacttcgttaggtacgtactagtcgtacgtccggtccgtcgtacgggttctacgtcgtccgtccgttccgtccgtactaccgtacgttcgtacggacgtaccgaccgtacccgtccctaccgtaccgtaccgttacgtccgttccggtaccgggtacctaccggtacggtacgtaacgggacggtacggtacggtacgtacgttaacgtttacgtcgtacgtcgtacgtccgtaactaacgtaaccgtaacgtaaacgtaacgtaaccgttacgggttacggtacggaccgggtaccggtaccggaccgtaacggtaccggtaccgtacgtacgtaccgtaccgtaccgtacgtcccgtacccgtacccgtacgtccgtccgtccg

SEQ ID NO: 42254 - DNA, 564 bp, Homo sapiens
  misc_feature: GYAE6OF01DRAB2.9.77.G11.1.454.CMB.1.raw
  modified_base (276)..(276): a, c, t, g, unknown or other
  misc_feature (276)..(276): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgtggcctggtatcagcaagaaaccagggaaacncccctaaactcctgatgtattatgcgtctagattagaaagtgggtaccatcaaggttcagcggcagcaatcgtggacagacttcactcacacatcaccagtctgcagcctgactgactttcgactaaagtttacttacgtcgaccaactaagttaacaagttaaacttttacgaccggttagaacttacgttaccggaacccgtaaagggacctaaaggggtacgaaaaacttacgaaaacggtaacgtggtacggccttaggaccctacctaagttccgtgttaccc

SEQ ID NO: 42255 - DNA, 560 bp, Homo sapiens
  misc_feature: GYAE6OF01BM3NC.9.77.G11.1.454.CMB.1.raw
  modified_base (337)..(337): a, c, t, g, unknown or other
  misc_feature (337)..(337): n is a, c, g, or t
  modified_base (417)..(417): a, c, t, g, unknown or other
  misc_feature (417)..(417): n is a, c, g, or t
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggcagtcagagtattgacacctcgttggcctggtatcagcagaaaccagggaaagcccctaaaactcctagatgtattatgcgtctagattagaagtgggtccatcaaggttcagcgnagccaatctggacagacttcactctcacatcacagtctgcagcctgatgacttcgactaagtttacttactgaccctaanagtacagtaatttatcccgtaggaactagttaccggacctaaagggaccctaaagggttacggaaaacttaccgaaaaaccggtaacgttacggtacgggtaccttacgggaccctaacccgatttcccgttaggtttacccc

SEQ ID NO: 42256 - DNA, 548 bp, Homo sapiens
  misc_feature: GYAE6OF01CQV7Z.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccggcagtcagagtattgacactcgtgcctggtatcagcagaaacaggaaacgccctaaactcctagatgtattatgcgtactagattaggaaagtcgggtccagtcaaggttcagcgcagccaaatcgtgggacagtacttcactctcacataccacagtctgcagctagatgacttcgactaagttactactgaccaactagtactaagtaactttacgtaccgtagtactagttccgggaaccgtaacgggaacctaagggtacggaaactaccgaaaacggtaacgttaggtacggtactacgacctacctaactccgttgttacccg

SEQ ID NO: 42257 - DNA, 611 bp, Homo sapiens
  misc_feature: GYAE6OF01C7DLU.9.77.G11.1.454.CMB.1.raw
  modified_base (275)..(275): a, c, t, g, unknown or other
  misc_feature (275)..(275): n is a, c, g, or t
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggcagtcagagtatgacacctcgttggcctggtatcagcaagaaaccagggaaacncccctaaactcctagatgtattatgcgtactaagagttaaggaaaggttcggggtacccagtacgtaaggttcaggcggacacgaccaatcgtagggactagacctttacacttctaccaaccattaccaacctagtcctagccacgtcctagactcgtaccttcgactaaagtttacttacctagaccctaaagtacgtaactagttaaacttttacgtaccggttaggtaacctacggttaccggaaccgtaaacggggtaaccctaaagggtacggaaaactacgaaaacggtacgttggacgtcgtacggaccaacctcttcgtgtttaccc

SEQ ID NO: 42258 - DNA, 540 bp, Homo sapiens
  misc_feature: GYAE6OF01DTHX8.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtcctccttccaccctgtctgcatctgtaggagacagagtcaccatcacttgccgggccagtcagagtattgacacctcgttgcctggtatcagcagaaaccagggaaacgcccctaaaactcctagatgtatatgcgtctagattagaaagtgggtccatcaaggttcagcggcagccaaatcgtggacagacttcactctcaccatcacagtctgcagctgatgacttcgactaagtttataacctgacccaatagtaacaagtaatttacgccgttaggactagttaccggacgtaaacgggaaccgaaagggtaggtaaaactacgaaaacgtacctggtaggactacggaccaaccgtctcgtcgttacc

SEQ ID NO: 42259 - DNA, 590 bp, Homo sapiens
  misc_feature: GYAE6OF01AI1OO.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctgatgtattatgcgtctagattagaaagtgggtcccatcgtaagttcagcggcagccaatcgtaggacagtacttcactctcaccatccacctagtctgcacgcctgtactcgtaccttcgacgttaagtttacttactcgaccctaaacgtagttaaccaagttaacttttacgtccgttaggtaacctacgttaccggaaccgtaacgggtaacccgtaaaggggtaacggtaaacgtaaccgaaaaccggtaacgtagggtacggtacgtacggacccaaccgtattccgtcgtttacc

SEQ ID NO: 42260 - DNA, 556 bp, Homo sapiens
  misc_feature: GYAE6OF01BUV40.9.77.G11.1.454.CMB.1.raw
  modified_base (275)..(275): a, c, t, g, unknown or other
  misc_feature (275)..(275): n is a, c, g, or t
  modified_base (374)..(374): a, c, t, g, unknown or other
  misc_feature (374)..(374): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtatgacacctcgttggcctggtatcagcagaaaccagggaaacncccctaaactcctgatgtattatgcatctagattagaaagtgggtcccttgaaggttcagcgcagccaatctggacagacttcactctcaccatcaccngtctgcagcctgactcgacttcgactaagtttacttaccgtagaccctaacagtaaccaagttaattttacgtccggttaggactacgttaccgggaccaaaggggaccctaaaggggtacggaaaacttacgaaaaacggtctaggtacggaccttggaccaacctatccgttggttaccc

SEQ ID NO: 42261 - DNA, 586 bp, Homo sapiens
  misc_feature: GYAE6OF01DOF2Z.9.77.G11.1.454.CMB.1.raw
  modified_base (276)..(276): a, c, t, g, unknown or other
  misc_feature (276)..(276): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacncccctaaactcctagatgtattatgcgtctagattaagaagtgggtccatacaaggttcagcgacacgccaatcgaggacagtactcactctacacatcactacgtctgcagcctgactcgtacttacgactaagtttacttacacgtaccaagtacgtaactaagtaacttttacgtaccggtaggtaactacgttaccgggaccgtaaacggggaacccgaaaggggttacggtaaaacgtaaccgtaaaaacggtaacgttagggtacggaccgttacgaccctaacccgtaattccgtgtttaccc

SEQ ID NO: 42262 - DNA, 571 bp, Homo sapiens
  misc_feature: GYAE6OF01CSM3R.9.77.G11.1.454.CMB.1.raw
  modified_base (377)..(377): a, c, t, g, unknown or other
  misc_feature (377)..(377): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacactcgttgcctggtatcagcagaaaccagggaaacgccctaaactcctagatgtattatgcatctagattagaaagtgggtacctagaagttcagcggcagcaatctggacagacttcactctcaccatctacagttcngcagcctgatcgacttcgactaagtttacttacgtacgaccaacgagtaacacgtaaatttactaccggttagtacctagttaccggaccgaaacggggacccgtaaagggtacggaaaacttaccgaaaacggtaacccgttgggtacgggaccttacgggaacccaaccctaacgttccgttcggtttaccc

SEQ ID NO: 42263 - DNA, 589 bp, Homo sapiens
  misc_feature: GYAE6OF01BYVNK.9.77.G11.1.454.CMB.1.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtcctccttccaccctgtctgcatctgtagganacagagtcaccatcacgttcgccggccagtcagagtatgacacctgttggcctggtatcagacaagaaaccgagggaaaccncccctaaactcctagattgtattatgtcgtatagattaaggaaaggtcgggtaccagtcgtaaggttcgacggcgacacgaccaagtcgaggacagtaccttcactcacacctatccacagtctagcagtcctagtactcgtacttacgacttaagttacttacgtacgaacccaataacgtactaagttaactttacgtaccggtagacctacggttaccggaccggtaaagggacctaaagggtacgtaaacgtaaccgaaacggtaccgtagggtacgactacgaccaccttatccgttgttaccc

SEQ ID NO: 42264 - DNA, 760 bp, Homo sapiens
  misc_feature: GYAE6OF01CVE3B.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctgggctcctgctgctctggctcccaggtgccaagtgtgacatccagatgacccagtctccttccaccctgtctgcatctgtaggagacagagtcaccatcacttgccggcagtcagagtattgacacctcgtggcctggtatcagcagaaaaccaagggaaacgcccctaaaactccgtagaattgtattaatgcgttactaaggtaattaaggaaaaggttcggggtaccccaagttacgaaagggtttccgaaggtccgggacaacgtacccaaaagttccgtaggggtaaccaggttaaccttaccgaaaccttcctacccaaccctaacgttacccaacccgtagttcctacggaccctaacggtcccttaggtaacgttacgtaaccgtttaccggacgtttaaacgtttaacgtttaacccgtacgtaacccctaaaagtaacgttaacctaaaggttaaacttttaacgttacccgggttaacggtaaccgttacggtttaccgggaaacccggtaaaacggggtaaacccgtaaaaggggttaacgggaaaaactttaaccggaaaaaaccggttaacgttacgggttaccgggaccgttacgggaaacccctaccgttaacttcccgttcgttttaacccg

SEQ ID NO: 42265 - DNA, 533 bp, Homo sapiens
  misc_feature: GYAE6OF01AHABI.9.77.G11.1.454.CMB.1.raw
  modified_base (522)..(522): a, c, t, g, unknown or other
  misc_feature (522)..(522): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcgtctagattagaaagtgggtccatcaaggttcagcggcagccaatctggacagacttcactctcaccatcaccagtctgcagcctgatgtacttcgactaagtttacttactcgacccaactagtaacagtaatttactccggtaggactagttccggaccgaagggaccgaagggtacggaaactaccgaaaacgacgtaggtacgacgtacgaccaaccnttcgtgttacc

SEQ ID NO: 42266 - DNA, 531 bp, Homo sapiens
  misc_feature: GYAE6OF01EPL3S.9.77.G11.1.454.CMB.1.raw
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (414)..(414): a, c, t, g, unknown or other
  misc_feature (414)..(414): n is a, c, g, or t
tcagtgatacgtctcacgaccggtgctcgatttagctagtcactcaagggaaagggggagtcagacccagtcaggacacagcatggacatgagggtccccgctcagctcctggggctccgtgctgctctggctcccaggtgccaagtgtgacatccagatgacccagtctccttccaccctgtctgcatctgtaggagacagagtcaccatcacttggccgggccagtcagagtattgacactgtgcctggtatcagcagaaaccagggaaagcccctaaacncctgattgtattatgcgtactaagattagaaagtgggtccatacaagtcagcgnagcaatctaggacagacttcaactctcaccatcaccagtctgcagctagactgacttcgctaagttatactgccaanagtaacagtaattactaccgtgactagttccggaccgaaagggaccgaaagggtaggaaaacttaccgaaaaccggtcgtaggtacgtaccgtcgaccaaccgacttcgtgttaccc

SEQ ID NO: 42267 - DNA, 624 bp, Homo sapiens
  misc_feature: GYAE6OF01DEL5C.9.77.G11.1.454.CMB.1.raw
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
tcagtgatacgtctcacgaccggtgctcgatttagctagtcactcaagggaaagggggagtcagacccagtcaggacacagcatggacatgagggtccccgctcagctccgtgggctcctgctgctctggctcccaggtgccaagtgtgacatccagatgacccagtcctccttccaccctgtctgcatctgtaggagacagagtcaccatccacttcgccgggccagtcagagtatgacacctcgttgcctggtatcagcagaaaccagggaaacncccctaaactcctagatagtattatgcgttactagtaattaggaaaggttcgggtaccctatcgaaggttcagcggcagccaatcgnggacagtactnactctcacatcacctagtctgacacgtcctaggacttcgtaaccttcggaactaaacgttttactaaccttcgaaccctaaacgtaacgttaactaaacgtttaacgttttacgaccccgggtttagggaaccgttacgtttacccgggaacccgtaaaaggggaacccttaaaggggtacgtaaaaacgtacgaaaaacggtacgttgggtaacgacgttcaacccgtactacgttcgtgtttacccg

SEQ ID NO: 42268 - DNA, 679 bp, Homo sapiens
  misc_feature: GYAE6OF01D7YF7.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtcctccttccaccctgtctgcatctgtaggagacagagtccaccatcactcgccgggccagtcagagtatgacacctcgtggcctggtatcagacaagaaaccgagggaaaccgcccccttaaactccgtagacttagtaattagtcgctagtctaagtaagttaaggtaacggttcggggttacccttagtaaacgggttcaggtccggacacgtaccaagtcgtagggactagtacctttcaccttccaccacctactacccaccaggttcctacgaccgtacgtcccgttagaccttacggtacctttaccggtacgtaacgttttactacctaccgaaccctaaagtaacgttaaccgtaaagttaaccttttacgaccggttagtaccgttaccgttcccgggaacgtaaacgggtaccgtaaagggtaccgtaaaacgtacccgaaaacggtaccgttagggtaccggaccttacgaacccgtaccttaacgtccgttaggttaccc

SEQ ID NO: 42269 - DNA, 561 bp, Homo sapiens
  misc_feature: GYAE6OF01DFVLT.9.77.G11.1.454.CMB.1.raw
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttcggccgggccagtcagagtattgacacctcgtggcctggtatcagacaagaaaccgaggaaacgcccctaaatcctagatgtattntgcatctaagtattaaggaaggtcgggtaccttacgaagttcaggcgacagacctaatcggtggactagtacttcactctacacctataccacctagtcncgcacgtctagacttcgtaacttcgaattaacgtttacttacncgtacctaaacgacgttactaaagtactttagtccgtaggactacgtaccgggacaaagggaccaagggtagaaaactacgaaagtacgtggacgactacgacactatccgttgtac

SEQ ID NO: 42270 - DNA, 628 bp, Homo sapiens
  misc_feature: GYAE6OF01C8ASX.9.77.G11.1.454.CMB.1.raw
  modified_base (102)..(102): a, c, t, g, unknown or other
  misc_feature (102)..(102): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagtgatacgtctcacgaccggtgctcgatttagctagtcactcaagggaaagggggagtcagacccagtcaggacacagcatggacatgagggtccccgntcagctcctgggctcctgctgctctggctcccaggtgccaagtgtgacatccagatgacccagtcctccttccacctgtctgcatctgtaggagacagacgtccaccatcacttcggccgggccagtcaggtagtattgactacctcgttggcctggtatcagacagaaaccgaggaacacccctaaactcctagtatgtattatgcgtctagattagaaggtcgggtccatcgtagttcagtcgacacgacctaagtcgtaggacngtacttcgactcncactactaccacagtcncgcacgtcctagatacgtacttcgacgtaagtttacttaacctacggtaccctaaacgtaacgttaacgtaagttaagttttacgtacccggttagtaaccgtcggtttaccgggaaccgtaaaacggggacccgtaaagggttaaccggtaaaacgtaaccggtaaaacggttaacggttaggtccggaccgttacgaccgtaacccttacgtcccgtttgttacccc

SEQ ID NO: 42271 - DNA, 683 bp, Homo sapiens
  misc_feature: GYAE6OF01CG51R.9.77.G11.1.454.CMB.1.raw
  modified_base (276)..(276): a, c, t, g, unknown or other
  misc_feature (276)..(276): n is a, c, g, or t
  modified_base (392)..(392): a, c, t, g, unknown or other
  misc_feature (392)..(392): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttcgccgggccagtcagagtattgacacctcgtggcctggtatcagcacgaaacgagggaacncccctaaactcctagatgtattatgcatactagtattaagtaaaggtcgggtacccttagaacggttcaggtcggacacgaccaagtcgtagggactacgtaccttacaccttacncctaccgtactaccgtaaccctacgtcctacgacctacgtacccttggaacttcgtaaccgtttccgtaacgttaacgtttactttaaccgtaccgtaacccgtaacttaccgtaaacgtaacggttaaacttttacggtacccggtttaggtaaccgttacggttcccgggaacccggtaaacggggtacccgtaaagggtaaccgggtaaaactaccggtaaaaccggtacgtacgggtacggtacgttaccggtacctaacccgttacttcccggttagtttaccccg

SEQ ID NO: 42272 - DNA, 699 bp, Homo sapiens
  misc_feature: GYAE6OF01CFAO7.9.77.G11.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
tcagtgatacgtctcacgaccggtgctcgatttagctagtcactcaagggaaagggggagtcagacccagtcaggacacagcatggacatgagggtccccgntcagctccgtggggctcctgctgctctggctcccaggtgccaagtgtgacatccagatgacccagtcctccttccaccctgtctgcatctgtagganacagacgtcacatcacgttgccggcagtcagagtatcgacaccgtgttgcctggtatcagacaacgaaccgagggaaaccnccccttaaactccagtactgtaattacgtcgtacgtactaaggaatttaaggaaacggttccgggtaacctaagtaccgtaaggtttcacggcggtacaacgacctaagtcgtaggaccagtaccttcgacttcactacactccacgtacgtcgtcgacgtacgcgtagtacgtacgtaccgtttacgaacttaacgttttacttaaccgtagtaacccgtaaacgttacgtaaacgttaacgttacgttttaacgtaccggttaccgtaacgttacggttaaccccgggaaagggtaaacccgggtaaaccgggttaaagggtaaacggtaaaaccgtaccggaaaaaccgggttacgttacggggttacgacgttaccgggaaccttacccggttacttaccgtccggttttaaccg

SEQ ID NO: 42273 - DNA, 637 bp, Homo sapiens
  misc_feature: GYAE6OF01AHG30.9.77.G11.1.454.CMB.1.raw
  modified_base (59)..(59): a, c, t, g, unknown or other
  misc_feature (59)..(59): n is a, c, g, or t
tcagtgatacgtctcacgaccggtgctcgatttagctagtcactcaagggaaagggggngtcagacccagtcaggacacagcatgggacatgagggtccccgctcagctcctggggctcctgctgctctggctcccaggtgccaagtgtgacatccagatgacccagtctccttccaccctgtctgcagtctggtaggagacagagtcaccgatcacttgccgggcagtcagagtattgacacctcgttggcctggtatcagcagaaaccagggaaacgcccctaaaactcctagatgtatagtgcgtctagtatagaaagtcgggtcccatcgaaggttcagcggcagaccaagtcgtagggacaggtactttacactctacgaaccatcccgaacctagtctgacctagtaccgtgtaattcggtaccttcgacgtaaagtttacttaccgtacggtaccctaaacgtacggtaaccgtagtaaacgttttacgtccggttaggaaccgtacgttccgggaaccgtaacggggtaaccctaaggggtaacggtaaaacgttacccgaaaaacggttaccggttacggtaccgggaccgttacgacccgtaaccctacgttccgttcggtttaccc

SEQ ID NO: 42274 - DNA, 549 bp, Homo sapiens
  misc_feature: GYAE6OF01AODM9.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctgatgtattatgcgtctagtattagaagtcgggtaccatcgaaggttcagcggcagccaatcgtggacagacttcactctcaccatccaccagtctcgcacgcctgatcgtacttcgactaagtttactactgaccaaacgtgtaactaaggtaatttacgtccgttagacctagttcccgggaccaaggggacctaagggtacggtaaactaccgaaacggtacgtaggtacgacgtacgaccacctactcgtggttccc

SEQ ID NO: 42275 - DNA, 520 bp, Homo sapiens
  misc_feature: GYAE6OF01DP1BM.9.77.G11.1.454.CMB.1.raw
  modified_base (276)..(276): a, c, t, g, unknown or other
  misc_feature (276)..(276): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggccagtcagatattgacacctcgttggcctggtatcagcaagaaaccagggaaacncccctaaatcctagatgtattatgcgtctagattaagaaagtcgggtaccatcgaaggttcagcggacagcaatcgtggacngactcactctacacatcacagtcngcagctgatgtacttcgactaagtttacttacngacctaagaagtacaagttaatttacgacgtagactacgttcggaccgaacgggaccgaaaggtacggaaactacgaaacgactggtagctgacactatctgtcc

SEQ ID NO: 42276 - DNA, 634 bp, Homo sapiens
  misc_feature: GYAE6OF01A3GNH.9.77.G11.1.454.CMB.1.raw
  modified_base (438)..(438): a, c, t, g, unknown or other
  misc_feature (438)..(438): n is a, c, g, or t
  modified_base (618)..(618): a, c, t, g, unknown or other
  misc_feature (618)..(618): n is a, c, g, or t
tcagtgatacgtctcacgaccggtgctcgatttagctagtcactcaagggaaagggggagtcagacccagtcaggacacagcatggacatgagggtccccgctcagctccgtggggctcctgctgctctggctcccaggtgccaagtgtgacatccagatgacccagtcctccttccaccctgtctgctatctggtaggagacagacgtcaccatcacgttcggccggaccagtcagtagtattcgactaccgttcggttcggccttggtatcgagaccaaggaaaccgagggaaccacccctaaactccgtagtagtagttattagtcgtacgttacgtaagtagttaacggaaagggtcgggtaccagtacgtaggtcaggcgacacgcaagtcgaggactacgtaccttacacttcaccactactccactcgtcncgacacgtctagtactcgtactcgtaattaacgtttactacgtcgaacctaacgtaacgtaactaagttaactttacgtaccggtacggtaacttacggtacccgggaacgtaaccgggtaaacgtaagggtaacgaacgtaaccgaaacggtcgttacggacgtacgtacgactaaccncgtttcgtgttacccg

SEQ ID NO: 42277 - DNA, 720 bp, Homo sapiens
  misc_feature: GYAE6OF01EXA3T.9.77.G11.1.454.CMB.1.raw
  modified_base (374)..(374): a, c, t, g, unknown or other
  misc_feature (374)..(374): n is a, c, g, or t
tcagtgatacgtctcacgaccggtgctcgatttagctagtcactcaagggaaagggggagtcagacccagtcaggaccacagcatggacatgagggtccccgctcagctcctggggctcctgctgctctggctcccaggtgccaagtgtgacatccagatgacccagtctccttccaccctgtctgcatctgtaggagacagagtcaccatcacgttcgccgggccagtcagtagtattgaccacctcggttggcctggtactcgagacaagaaaaccgaggggaaacacccctaaactcctagattgtattatgcgttacgtaagtattaaggaaaggttcgggtacccagtaccgtaaggttcgaggcgganacggacctaaagtcgtaggaacacgtacttacgaccttctaccaacctactaccaaccgtagttcgtcgaccacgtccctagtaagttcggtaactttccggaacttaacggttttaacttaccgttaaccgaccctaaacgttacggtaaactaacgtttaaacgttttaccgttaccggggttaggtaacccgttacggttaacccgggaaccggaaaccgggggtaaacccgttaaaaggggttaaaccggtaaaaccgttaaccgaaaaacccgggtaacggtttacgggacggttacccgtaaggaccccgtaaacctacgtttaccgttgtttaaccccg

SEQ ID NO: 42278 - DNA, 719 bp, Homo sapiens
  misc_feature: GYAE6OF01AX8HU.9.77.G11.1.454.CMB.1.raw
tcagtgatacgtctcacgaccggtgctcgatttagctagtcactcaagggaaagggggagtcagacccagtcaggacacagcatggacatgagggtccccgctcagctccgtggggcctcctgctgctctggctcccaggtgccaagtgtgacatccagatcgacccagtcctcccttcccaccctgtctgcatctgtaggagacagagtcaccatcacttcggccggcagtcagagtattcgactacctcgttcggctggtatcgagcaagaaaaccgagggaaacctcccctaaagtcctagattgttaattatcgcgttacgtaagtaagtttaagggaaacggtttccggggtaccctaagttaccggtaaacgggttccgaagggtccgggaactacgtaccctaaggtccggttacgggaactacggtacctttacacctctacccacctatacccacgtcgtcgtacgacctacgccctaggtccgttgtaaccgtttcgaactttaacgttacttaccggtaccgtaacctaaagtaaccgttaacttaacgtttaacgttttaccgaccggttaacggtacttaccggttaccgggaacccgtaaacggggtaaccgtaaaacgggttaacggaaaacgttaacccgaaacgttaaccgtacgggtccggtacctacggtaacccaccgttacgttccgttcgttacccg

SEQ ID NO: 42279 - DNA, 912 bp, Homo sapiens
  misc_feature: GYAE6OF01AHDT0.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggcctcccaggtgccaagtgtgacatccagatcgacccagtcctcccttcccacccttgtctgctatctggtaggagacagacgtaccaccagtctaccgttcggcccgggccagtccgaggtagttagttacgaaccgtacccgttcggttcggtcccgttagggtactccgaggaccaaacggaaaaccgaacggggtaaaaccctacccccttaaaaccgtccgtaggtaattacgttaattcgtaggtcccgttaagttaaggttaagttaacggtaaacgggtaccggggttaccctaagtaaccgtaaaggttcgaagggtccggacgtaaccggtaccgtaaagttcccggtagggtaacctacggttacccttaccgaaccctcctaccaacctactacccgaaccgttcggtacctcgaccgtaacccgtccgttaggtaacgttaccgggttaacccttaccggggttaaacttttaaccgtttttaaccgttacccgggtacgtaaaccccctaaaagggtttaaacccgttaaaccggttaaaggtttaacgtttttacccgggtaacccgggtttaaggtaacccggtttaaccgggtttaacccgggaaaacccggggtaaacggggttaaaaccccgggttaaaggggttaaaaaccgggtaaaccttaaaacccgggtaaaaaccggtcccggggtttaagggttaccccggaccgtttaaaccggacccttaaccgtttactttacccgggttttacctttaccccg

SEQ ID NO: 42280 - DNA, 764 bp, Homo sapiens
  misc_feature: GYAE6OF01CFYB4.9.77.G11.1.454.CMB.1.raw
  modified_base (236)..(236): a, c, t, g, unknown or other
  misc_feature (236)..(236): n is a, c, g, or t
  modified_base (451)..(451): a, c, t, g, unknown or other
  misc_feature (451)..(451): n is a, c, g, or t
tcagtgatacgtctcacgaccggtgctcgatttagctagtcactcaaagggaaagggggagtcagacccagtcaggacacagcatggacatgagggtccccgctcagctcctggggctcctgatgctctggctcccaggtcgccaagtgtgacatccagatcgacccagtctcccttccacctgtctgctatctgtaggagacagagtcaccatcacgtggccgcagtcagtagtnttagacttacgtcgttcggacctggtactacagacaaacgaaaccgacggaaacctacccctaatccgtagtatgttacttagtcgtacgttatagtaagttaacggaacggtcggtacctagtacgtacggttcgaacggcgacgtacgacgtaacgtcggacggaactacgtacttacctacctactaccctactactacccacctcgttacncgtaccgagtcctagtaactaccggtacgtttaaccgtacgtttaaacgtttacgtaaccgtaccgtaacccgtaaaattaccggttaaacgttaaacgttttaaaccgttttaccggaaccgggtttaaccgttaacccggttagggttaacccccgggaaaacgggtaacgggtaaaaaccggttaaagggggttaaaaccgtaaaaaccggtaaacccggttaaaacgtttaccgggacgggggttaccctacccggtaacgaaacccccttaggggtttaacccttccggtttttacccgttaaccccg

SEQ ID NO: 42281 - DNA, 767 bp, Homo sapiens
  misc_feature: GYAE6OF01EYZWL.9.77.G11.1.454.CMB.1.raw
  modified_base (102)..(102): a, c, t, g, unknown or other
  misc_feature (102)..(102): n is a, c, g, or t
  modified_base (460)..(460): a, c, t, g, unknown or other
  misc_feature (460)..(460): n is a, c, g, or t
tcagtgatacgtctcacgaccggtgctcgatttagctagtcactcaagggaaagggggagtcagacccagtcaggacacagcatggacatgagggtcccccntcagctccgtggggcctcctgctgcctcgtggcctcccgagggtcacctaagttgtgactactcagtactcgaccctagtccttccctccacccgttgtctgctactcgttaggaaggactacgaggtacgtaccacctagttaccgtacgtttccgggacccggtaccagttacgaaggtacgtttacgttacggacccgttaccggttcgtttccggacggttagtactacgacgaacgaaaccggtaaacggaccgggtaaacctaacccccgttaactcgtaagtactttgtaacttggtcggtactcgtaagtaacgtaagggtacgttccggactagtacgtacgtgacggngtaccgagaccgtagttccggaggtaactaccgttcttacaccctcttaaccacgacctacgtacgtacgtcgtaccgacgtacgtacgtgtacgtaccggttaccgttaacgttaccgtaagtttaccgttaccaaccgtaaccgtacgtaacgttaacgtaccgtttaacgttacgttccggtaaccgttacgtacggttacccggacgggtaaaccgtacgggtaaccggttaacgtaacgtaaaccggtaacggttacgtcggtagtaaccgtcgtaccttaagtccgtttacgtgttacccg

SEQ ID NO: 42282 - DNA, 805 bp, Homo sapiens
  misc_feature: GYAE6OF01BI0A6.9.77.G11.1.454.CMB.1.raw
tcagtgatacgtctcacgaccggtgctcgatttagctagtcactcaagggaaagggggagtcagacccagtcaggacacagcatggacatgacgggtccccgctcagctccgtggggcctcctgctgctctcggcctcccgaggtcgacctaagtgtgacatccgagatacgaccctgtcctcccttcccaccctgtcctgctactcgtaggtaggacgacgagtacgtccaccatacctacgtcggacccggaccagtacagtacgtatacgacctaccgttcggttcggccgttaggtactacgagacgaaaccggaaaccggaacgggaaaccctaccccctaactccgtaggtacttagttacttagtcggtacgttagtaaggttaagttaacgggtaaacgggttccggggtacctaggttacggtaaccgggttacggaccgggacccggacgtaaccggtacctaacggttaccggtaacgggtacctaaccggttacccttaccgtaacccttccctaccgtaacccgtacctaccgtaacccgtcgttaccgtaccggactacgtccgttaagtacgttccggttaacctaccggtaacgtttaacgttacttacccggaaccaacctaacgtcgttaaccgttaaacgtttactttccggttaacgggttactaacggttacccggtaccgggaaccgtaacggggtaaacgtaagggtaaccgtaaacgttaacccgaacggttctaccgggtacaccgttaccaccgttaccttctccgttccgtttacccg

SEQ ID NO: 42283 - DNA, 833 bp, Homo sapiens
  misc_feature: GYAE6OF01D8WLU.9.77.G11.1.454.CMB.1.raw
  modified_base (205)..(205): a, c, t, g, unknown or other
  misc_feature (205)..(205): n is a, c, g, or t
  modified_base (802)..(802): a, c, t, g, unknown or other
  misc_feature (802)..(802): n is a, c, g, or t
  modified_base (826)..(826): a, c, t, g, unknown or other
  misc_feature (826)..(826): n is a, c, g, or t
tcagtgatacgtctcacgaccggtgctcgatttagctagtcactcaagggaaagggggagtcagacccagtcaggacaaagcatggacatgagggtccccgctcagctccgtgggctcctgctgctctggctccgaggtgccaagtgtgacatccgatatcgacccagtcctcctccacccttgtctgctatctagtaggagacngtacgtccaccgtatacctacgttcggccggtacctacgtacgaacgtagttacgtcaaccgtccgttcggttcggtccgttaggtactacgaacggaaccgtaaacggaaaacccggaacggtaaacccgtacccctaaaccgttccgtagtaagttacgttaatttacggtacgtaccgttaacgtaagttaacgttaacggaacgggttccgggtaaccctaagttaacgggtacgtaccgaacggtccggtaaccgacgtaacccgtacggtttaccggaacgggtaactaaccgtaccctttacccgaccttaccctaccgaacccgttaactaccccgtaacgtacgttccgaggtaccctaaacggtcttaacggtacgttaccgttcccgttaacggttaaaccttaaacggttttacctaaccggccgtaaacctaaggtaaccgtaactaacgtttaccggttaccgtccgggtaaacgttaccggtaaccggttacccgggaaacgggaaacgggtaccggtaaaacgggttaaccgtaaaaactaacccgggggtaattaacccggtggggacctacggtaaccncgtacttaccgttcgttaaccgtnttccccg

SEQ ID NO: 42284 - DNA, 614 bp, Homo sapiens
  misc_feature: GYAE6OF01AWDLH.9.77.G11.1.454.CMB.1.raw
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttcgccgggccagtcagagtattgacacctcgttggcctggtatcagcaagaaaccaggggaaacgacccctaaactcctagactgttattatgacgttctagtagttaagaaacggttcggggtacccagttacgtaaggtttaccgaggccgggtcaacggccctaaagtcgtacgggacacgtaccgttacacctcgtaccacctatccaccngtcctgacacgtcctagngttacgacttcgacttaactttacttacgtacgacccaacgtgaactagtaactttacgcggttagactacgttaccgggacgtaacgggaccgtaagggtacgaaacgtactaaaacggtactacgggtagccttacggaccctaccgtcttacgtcgtttacccg

SEQ ID NO: 42285 - DNA, 500 bp, Homo sapiens
  misc_feature: GYAE6OF02I26FV.9.77.G11.1.454.CMB.1.raw
tcagtgatacgtctcacgaccggtgctcgatttagctagtcactcaagggaaaggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcgtctagattagaaagtggggtcccatcaagttcagcggcagccaatctgggacagacttcactctcaccatcaccagtctgcagcctgatgacttcgcaagttattactgaccaacagtacagaatttatccgtgacattcggaccaagggaccaaggtggaaactacaaacgtaactgtaggctggccaccatctgttcc

SEQ ID NO: 42286 - DNA, 553 bp, Homo sapiens
  misc_feature: GYAE6OF02ILN4V.9.77.G11.1.454.CMB.1.raw
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
tcagtgatacgtctcacgaccggtgctcgatttagctagtcactcaagggaaagggggaggtcgagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccaggtcagagtattgacacctcgttggcctggtatcagcagaaaccagggaaagcccctaaatccctgatgtattatgcatctagattagaaagtgggtccttnaaggttcagcgnagccaatctgggacagacttcgactctcacatcaccagtctgcagcctgatgacttcgctaagtttatactgacctaaacngttaacagaattttagacccggttggaacctaatttccgggacccaaaggggtacccaagggttcggaaaacttccgaaaaccggtaacgttggtacggccttaggcccaacccgtattaccgtggttaccc

SEQ ID NO: 42287 - DNA, 525 bp, Homo sapiens
  misc_feature: GYAE6OF02IWT4T.9.77.G11.1.454.CMB.1.raw
  modified_base (422)..(422): a, c, t, g, unknown or other
  misc_feature (422)..(422): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaaactcctgatgtattatgcgtctagattagaaagtgggtcccatcaaggttcagcgcagccaatctgggacagacttcactctcaccatcaccagtctgcagcctgatgacttcgactaaagtttattactgacccaanagtaacagtaatttatccgtagactagttcggaccaagggaccaagggtacggaaaataccgaaaacgtaactggtaggctacggacaaccattcctgttacc

SEQ ID NO: 42288 - DNA, 573 bp, Homo sapiens
  misc_feature: GYAE6OF02I5SDA.9.77.G11.1.454.CMB.1.raw
  modified_base (326)..(326): a, c, t, g, unknown or other
  misc_feature (326)..(326): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaatccctgatgtattatgcatctagattagaagtggggtcccttnaaggttcagcggcagccaatctgggacagacttcactctcaccatcaccagtctgcagcctgactgaccttcgactaagttattactgaccaactagtacagtaaatttacgtccgttaggaactagtttaccgggaccgtaaaggggacccgtaaagggttacggaaaacgttaccgaaaaaccggtaaacgttacggttagggaccttacggaccctaacccgtacttaccgttacggtttaccc

SEQ ID NO: 42289 - DNA, 535 bp, Homo sapiens
  misc_feature: GYAE6OF02IO3VZ.9.77.G11.1.454.CMB.1.raw
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctagatgtattatgcgtctagattaagaaagtgggtcccatcaaggttcagcgcagccaatctgggacagacttcactctcaccatcaccagtctgcagcctgatgacttcgactaagtttattactgacctaanagtacagtaatttanccgttagactagttccggaccaagggaccaagggtacggaaaataccgaaaacggtaacgttaggtacggactacggacctaccgattccgtgttacc

SEQ ID NO: 42290 - DNA, 496 bp, Homo sapiens
  misc_feature: GYAE6OF02G4V0E.9.77.G11.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (488)..(488): a, c, t, g, unknown or other
  misc_feature (488)..(488): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcatctagattagaagtggggtcccttnaaggttcagcgnagccaatcnggacagacttcactctcaccatcaccagtctgcagcctgatgacttcgctaagttattactgaccaacagtacagtaatttatccgtgacagttcgaccaagggacaaggtaggaaatacaaacgaactgagctgacaccntctgttac

SEQ ID NO: 42291 - DNA, 551 bp, Homo sapiens
  misc_feature: GYAE6OF02IU6MY.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgacccctaaaactccctagatggtattatgcgtctagattagaaagtggggtcccatcaaggttcagcggcagccaatcgtgggacagactcactctcacactcaccagtctgctagcctagatcggtacttcgactaaagtttacttactcgtaaccaatacggtacaagttaaactttacgtccgttaggaactacgttacggaccgaagggaccgaaggtaaggaactaccgaaacgtaactacggtagcgtgaccaccgtattcgtgttacc

SEQ ID NO: 42292 - DNA, 594 bp, Homo sapiens
  misc_feature: GYAE6OF02GJRTW.9.77.G11.1.454.CMB.1.raw
  modified_base (417)..(417): a, c, t, g, unknown or other
  misc_feature (417)..(417): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaaactcctgactgtattatgcgtctagattagaaagtgggtcccatcaaggttcagcggcagccaatcgtggacagacttcactctcaccatcacagtctgcagcctgactgacttcgactaagtttacttacgngtacccaaacgtacgtaactaagtaaattttacgtccgttagggaacctacggttaccgggaccctaaagggggtaccctaaaggggtacggtaaaacttaccgaaaaaccggtaaccgttagggtaacgggtacttacggacccgtaaccgtacgtttacccgttagtttaccccg

SEQ ID NO: 42293 - DNA, 526 bp, Homo sapiens
  misc_feature: GYAE6OF02F8ASO.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctgatgtattatgcgtctagattagaaagtgggtccatcaaggttcagcggcagccaatctgggacagacttcactctcaccatacaccagtctgcagcctgatcgacttcgactaagttacttactcaccaacagtacagtaattactccgtgacagttacggaccgaagggacctaagggtacgaaaactacgaaaaccgtacgtaggtaggacttcgacctaccgattctgttacc

SEQ ID NO: 42294 - DNA, 531 bp, Homo sapiens
  misc_feature: GYAE6OF02GQM0R.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttgacctggtatcagcagaaaccagggaaacgcccctaaactcctgatgtattatgcgtctagattagaagtgggtccatcaaggttcagcgcagccaatcgtggacagacttcactctcacatcaccagtctgcagcctgactgacttcgactaagttattactgaccaacagtaacagtaatttacgtccgtagactattacggaccgaagggaccctaagggtacggtaaagtaccaaaacggtaacgtggtaggacctaggaccaaccattccgtgtttaccc

SEQ ID NO: 42295 - DNA, 562 bp, Homo sapiens
  misc_feature: GYAE6OF02IMQMA.9.77.G11.1.454.CMB.1.raw
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctagattgtattatgcgtctagattagaaagtgggtccatcaaggttcagcggcagccaatcgtgggacagacttcactcncaccatcaccngtctgcagcctgatcgacttcgactaagtttacttacgnaccaactagtaacaagtaactttacgtccggttagtaacctagttaccgggaccgtaaacggggtaccgtaaagggtaggaaaacttaaccggaaaacgtaacgtaggtaggtactcggtaccaacctagttccgtagttaccc

SEQ ID NO: 42296 - DNA, 529 bp, Homo sapiens
  misc_feature: GYAE6OF02IM1PD.9.77.G11.1.454.CMB.1.raw
  modified_base (276)..(276): a, c, t, g, unknown or other
  misc_feature (276)..(276): n is a, c, g, or t
  modified_base (327)..(327): a, c, t, g, unknown or other
  misc_feature (327)..(327): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacttcgttggcctggtatcagcagaaaccagggaaacncccctaaaactcctgattgtattatgcatctagattagaagtgggtccttnaggttcagcgcagccaatctgggacagacttcactctcacatcaccagtctgcagcctgactgacttcgactaagttattactgaccaacagtacagtaatttataccgtagtactagttacggaccgtaagggaccaaagggtaggaaactaccgaaaacggtaactaggtaggactcggaccaaccgacttacgtgtacc

SEQ ID NO: 42297 - DNA, 537 bp, Homo sapiens
  misc_feature: GYAE6OF02H91Z8.9.77.G11.1.454.CMB.1.raw
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggcagtcagagtatgacacctcgttggcctggtatcagacaagaaaccagggaaacgacccctaaactcctgatgtattatgcgtctagtattaagaagtcgggtccatacaaggttcagcgcgacncaatcagggacagtacttcactctcacctatccacagtctgcagcctgatgaccttcgactaagttattactgaccaanagtacagtaatttagtccgtgaactagttaccgaccgaagggaccgtaagggtagtaaacgtaccgaaacgtaagtcggtacggtacgtacgaccacctacttctagttccc

SEQ ID NO: 42298 - DNA, 561 bp, Homo sapiens
  misc_feature: GYAE6OF02F3HMZ.9.77.G11.1.454.CMB.1.raw
  modified_base (348)..(348): a, c, t, g, unknown or other
  misc_feature (348)..(348): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctgatgtattatgcgtctagattagaaagtgggtcccatcaaggttcagcggcagccaatntgggacagacttcactctcaccatcaccagtctgcacgcctgactgacttcgctaagttattactgaccaaacagtaacaagtaaacttttagtccgtaggacctagttaccggaccgaaaggggtacccaaagggttacggaaaaacttaccgaaaaaccggtaaccgttggtacgggtaccttcggacctaaccgtacttcctagttaccc

SEQ ID NO: 42299 - DNA, 623 bp, Homo sapiens
  misc_feature: GYAE6OF02H4U6Q.9.77.G11.1.454.CMB.1.raw
  modified_base (483)..(483): a, c, t, g, unknown or other
  misc_feature (483)..(483): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccggccagtcagagtatgacacctcgttggcctggtatcagcaagaaaccagggaaagccccgtaaaatccctagacttgtatatgactctagaattaagaaaggttcggggtccaattacgaacgggtttcaacggcgggacaacggacctaaacgtcgtacggggaacaagacctttcgaactcctaccaacctatccaaccctaagttcctggactacgtccgtgaattcgttaaccgttcgactaaaaggtttactttaaacncgaaccctaaataaggttaacagtaaattttagacccgttaggaaccagttacgggaccaaagggacctaagggtaaggaaacgtaaccgaaaacgtaacgttagtcggacttcgacctaacctataccgttgttaaccc

SEQ ID NO: 42300 - DNA, 619 bp, Homo sapiens
  misc_feature: GYAE6OF02GXZWK.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggccagtcagagtatgacacctcgttggcctggtatcagcaagaaaccgagggaaacgacccctaaactcctgatgtattatgcgtctagtattaagaaaggtcggggtacccagtacgaaggttcaggcggcagaccaatcgtagggacagtacttcactctacaccataccaccagtcctgccagtcctaggatgtacttcgacttaagtttacttactgaccctaacaacgttaacctaagttaacttttacgtacccggtaggtaacctacggtttaccgggaacccggaaacggggtaacccgtaaaggggttaacggtaaaacgtaaccgtaaaacggtaaccggttagggtacggtaccgttacggacctaaccgtagttccgtactttaccg

SEQ ID NO: 42301 - DNA, 556 bp, Homo sapiens
  misc_feature: GYAE6OF02IHHH1.9.77.G11.1.454.CMB.1.raw
  modified_base (403)..(403): a, c, t, g, unknown or other
  misc_feature (403)..(403): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtaggagacagagtcaccatcacttgccgggccagtcagagtatgacacctcgttggcctggtatcagcagaaaccaggggaaacgccccttaaaactccctagactgttattatgcgtctagtatttaagaaaggttcggggtaccccagtacaaaggtttcaaggtcggcagccaaatcgtagggacagacttcactctcaccatccaccngtctgcagcctagactacgactttcgactaagtttattacncgaccaanagtaacagtaatttagtccgtagacctagttccggacaagggaccaagggtacgaaataccgaaacgtaacgttggagtcgtagaccactaacgtctagttacc

SEQ ID NO: 42302 - DNA, 1039 bp, Homo sapiens
  misc_feature: GYAE6OF02IT1EV.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccctatacctacgttcggccggacgacgtacgagtagttagttaccgaacctaccgtttcgggttccggtaccgttggttactacgacgacgaaaacccggaaacggaaaacggggtaacccctaaaccccttaaaccgttcgtaagtagttacgtttaaagttagtaccgtcgttacgtaacgttaaaggttaaacggtaaacggggttcccggggtaaccttaacgttaaaccgggtaacggtttccgaacgggtccggaaccgtaccgaaaccgtaagtccggggttaacgggaacctaacggtttaccttaacccgtaccctttacccttaacccaaacccgttacctaaccccgtaacgttaccggtttacgtaccgaacggttaccgtacccggttaagttaaccggttccgtttaaaccggttacccgtaaaacgttttaaacgggttttttaaacccttacccgggtaacccttaaaacccgaaaacgtttaaaccggttaaaccggtttaaaaacggtttttaaaaccttttttaacccgggttaacccgggggtttaaacgtaaaaaccccggggttttttaacggtttaaaccccccggggggaaaacccggtaaaaaaccccggggggttaaaccgggttttaaaaacgggggtaaaaacccgggggttttaaaaaacccttaaaaaccccggggtaaaaaaacccgggttttcggttttaaacccgggggggtaacccggtttcccggtaaacccgggtaacccccgtttaaaccccgttaaaccggtttttcccgttttacccgggttttaaacccccg

SEQ ID NO: 42303 - DNA, 621 bp, Homo sapiens
  misc_feature: GYAE6OF02IDW7E.9.77.G11.1.454.CMB.1.raw
  modified_base (128)..(128): a, c, t, g, unknown or other
  misc_feature (128)..(128): n is a, c, g, or t
  modified_base (239)..(239): a, c, t, g, unknown or other
  misc_feature (239)..(239): n is a, c, g, or t
tcagtgatacgtctcacgaccggtgctcgatttagctagtcactcaagggaaagggggagtcagacccagtcaggacacagcatggacatgagggtccccgctcagctccgtggggctcctgctgctntggctcccaggtgccaagtgtgacatccagatcgacccagtcctccttccaccctgtctgcatctggtaggagacagacgtcaccatcacttggcccgggcagtcagagtntgaccacctcgttggcctggtatcagcaagaaaccgagggaaactacccctaaactcctagacttgtattagtggcgttactaagtaagtttaaggaaagggttcgggtaccccagtacgtaaggttcaggcgacagccaatcgtagggacagtacttcactcaccacctatacccgaactacgtcctagctacgtcctagtactcgtacttcggattaaacggtttattaccgtcgaacccaagtacgtaactaacgttaaattttccgtcgtagtaacctcgggttacccgaacgaaacgggtaccgtaaagggttaccggaaaactaccgaaaacggtacgttggtacggcgtacgacctaccgtattacgtcgttacc

SEQ ID NO: 42304 - DNA, 579 bp, Homo sapiens
  misc_feature: GYAE6OF02GOSE3.9.77.G11.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
tcagtgatacgtctcacgaccggtgctcgatttagctagtcactcaagggaaagggggagtcagacccagtcaggacacagcatggacatgagggtccccgctcagctcctggggctcctgatgctctggctcccaggtgccaagtgtgacatccagatgacccagtctccttccaccctgtctgcatctgtagganacagagtcaccatcacttgccgggccagtcagagtattgacaccttcgttggcctggtatcagcaagaaaccaggggaaacncccctaaactcctagatgtattatgcgtctagattaagaagtcgggtccatcgaagttcagcgcagccaatcgtggacagtactcactctacaccatccacctagtctgacacgcctagactgtacttcgacttaagttacttactcgtaccaaacgtagtaactagttaacttttacgccgttagacctacgttaccggaccgaacggggtacctaaggggtaacgtaaaccgtaaccgaaaccggtacgttaggtacggtacctacggaccctaaccgtacttaccgtacgtttaccc

SEQ ID NO: 42305 - DNA, 638 bp, Homo sapiens
  misc_feature: GYAE6OF02HBN3U.9.77.G11.1.454.CMB.1.raw
  modified_base (197)..(197): a, c, t, g, unknown or other
  misc_feature (197)..(197): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtcctccttccaccctgtctgcatctgtaggngacagagtcacatcacttgccggcagtcagtagtatgacactcgtgcctggtatcagcagaaccaggaacgcccctaaactcctagactgtattatgtcgtctagtattaaggaaggtcgggtaccagtctaagttcagcggcagccaaagtcgtaggactagtacctcactactcaccacgtccaaccgtacgtctacgctacgcctagactacgtaccttacggtactaagtttacttaccgtacgaacctaacgtaagtaaccgtaaacgttaatttaccgtaccggttaacggttaaccgtaacggtttacccgggaacccgtaaacgggtaacccgtaaacgggggttaacggaaacgtaaaccgtaaaaccggtaacggttacggttacggtaaccgttcggaaccctaccggtaacgttccgttcgttaacccg

SEQ ID NO: 42306 - DNA, 626 bp, Homo sapiens
  misc_feature: GYAE6OF02JXRX1.9.77.G11.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
tcagtgatacgtctcacgaccggtgctcgatttagctagtcactcaagggaaagggggagtcagacccagtcaggacacagcatggacatgagggtccccgntcagctcctggggctcctgctgctctggctcccaggtgccaagtgtgacatccagatgacccagtctccttccaccctgtctgcatctgtagganacagatcaccatcacttgccggccagtcagatatgacactgtgcctggtatcagcagaacaggaacnccctaaatccgagacttagtacttagtcgacgtactaagtagttaagaaaggttcgggtacccagtacgtaaacggttcaacggcggtacacggtacccaaagtcgtagggactaacgtacttcgaactctacacctatccaaaccgtgtaccctgaccgaacgtcccgttaggactacgtacctttaacggacttaaacgttttacttacgcgtaacctaacgtaaggtacctaaggttaaactttcgtaccgtagtaaccgtacgttaccggaccgtaacggaccgtaaaggtacggtaaactacgtaaacggtaccttaggtacggtactcggaaccctactacgtacgttacgttacc

SEQ ID NO: 42307 - DNA, 592 bp, Homo sapiens
  misc_feature: GYAE6OF02FO002.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttgcctggtatcagcagaaaccagggaaacgcccctaaactcctgatgtattatgcgtctagattagaagtgggtccatcaaggtcagcggcagccaatcgtaggacagacttcactcctacacctatcaccctagtcctagcacgcctagatacgaccttacgacgtaagttacttactcgacctaacgagtaaccagttaaatttacgtaccgtaggtaactacgtttaccgggaacccgtaaggggtacccaaaggggtacggtaaaagttacccgaaaaaccggtacgttacggtagggtacccttagggacccaacccgtatttacccgtaggtttaaccccg

SEQ ID NO: 42308 - DNA, 766 bp, Homo sapiens
  misc_feature: GYAE6OF02IS1E1.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctgggctcctgctgctctggctcccaggtgccaagtgtgacatccagatgacccagtctccttccaccctgtctgcatctgtaggagacagagtcaccatccacttgccgggccagtcagagtattgacctacctcgttggcctggtatcagcaagaaaccgagggaaacacccctaaactcctagatagtattatcgcgttactagtaacttaggtaaaggtcgggtacctagttaccgtaaaggttcacggacggactacggacctaacgttcggtacggggaactaacgtacgtttccaaccgttacctacgaaccctaactcccgtaaacctacggttacctacggtaccgtaacggtaccccgttgtaacgttaccggttaccgttaacccggtacgtttaaaacgttttaccgtttaaccgttaccgtaaccccgtaaacgtaaactttaacccgtaaagtttaaaccgtttttaaccgttaccgggtaacggttaaacccgttacggtttacccggaaacccgggtaaccgggtaaacccggtaaggggttaaccggtaaaacgtaacccggtaaaaccggttaacggttacgggtcggtaaccgtaccggtacccgtaacctaaccgtttcgtttaacccgtttacccg

SEQ ID NO: 42309 - DNA, 546 bp, Homo sapiens
  misc_feature: GYAE6OF02II2T8.9.77.G11.1.454.CMB.1.raw
tcagtgatacgtctcacgaccggtgctcgatttagctagtcactcaaaggggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccgagggaaacgcccctaaactcctagactgtattatgcgtctagattagaagtgggtaccatcagttcagcgcagcaatcgaggacagacttcactctcacctatccaccagtctgcacgcctagatcgacttcgactaagttattactcgaccaactagtactagtaaatttacgtcgtacgtactacgttaccggaccgaacgggacctaagggtaacggaaactacgaaaacgtaacgtggtaggtcgtacgaccaccgtacttccgtacttccg

SEQ ID NO: 42310 - DNA, 627 bp, Homo sapiens
  misc_feature: GYAE6OF02I7M5J.9.77.G11.1.454.CMB.1.raw
  modified_base (197)..(197): a, c, t, g, unknown or other
  misc_feature (197)..(197): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtagganacagagtcaccatcacttcgccgggccagtcagtagtattcgactacctcgttcggccgtggtactcagcaacgaaaccgagggaaaccgtacccctaaactcctagattgttattagtgtcgtactaagtagttaaggaaacggttcggggtaccctaagttacgtaaacgggtttcacggtcggacacgtacctaagtcgtacgggaactacggtaccttaccgacttcctaccacctactacccaccgtagtccgtcgacctacgtccttagacgttcgtacctttacgacttaaagtttacttacgtacgaccaatagtactaagttacttacgtcgtagtctacgtcgacgtaacggacgtaaggtagtaaactaccgaaaaggtcgtacggtagtacgtacgacctacctagttctacgttacc

SEQ ID NO: 42311 - DNA, 556 bp, Homo sapiens
  misc_feature: GYAE6OF02FG8Z8.9.77.G11.1.454.CMB.1.raw
  modified_base (272)..(272): a, c, t, g, unknown or other
  misc_feature (272)..(272): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggcagtcagagtattgacacctgtggcctggtatcagcagaaaccagggaacncccctaaactcctgatgtattatgcatctaagtattaagaaaggttcggggtacccttgaaggttcaggcggacagaccaatcgtggacagtacttcactctcaccatcacctgtctgcagcctgatcgacttcgactaagttactactcgaccaagtacgtaacagttaactttacgtaccggttaggacctaggttccggaccgtaacgggaccaagggtacggaaaactccgaaaacgtacgttggtacgtacgtacggaccctaccacgttctagttacc

SEQ ID NO: 42312 - DNA, 591 bp, Homo sapiens
  misc_feature: GYAE6OF02FG87E.9.77.G11.1.454.CMB.1.raw
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtccaccatcacttcggccgggccagtcagagtattgacacctcgttggcctggtatcagcaacgaaaccaggggaaacgcccctaaactcctagatgtattatcgctntaagattaagaaaggtcggggtacccatcgtaaggttcagcggacacgaccaatcgtgggacagtactcactcncaccatcacngtctgcacgcctgatcgtacttcgactaaagtttactactcgaccaaacgtacgtaactaagtaattttacgacccggttaggaacctacggttaccggaccgtaacgggacccgtaaagggtacggaaaacttacgaaaaccggtaaccgtggtaacgggcttacggaccctacgtacgttccgttacgttaccc

SEQ ID NO: 42313 - DNA, 666 bp, Homo sapiens
  misc_feature: GYAE6OF02HME84.9.77.G11.1.454.CMB.1.raw
tcagtgatacgtctcacgaccggtgctcgatttagctagtcactcaagggaaagggggagtcagacccagtcaggacaaagcatggacatgagggtccccgctcagctcctggggctcctgctgctctggctcccaggtgccaagtgtgacatccagatgacccagtctcccttccaccctgtctgcatctgtaggagacagagtcaccatccacttcggccgggcagtcagtagtattgacctaccgttcgttcggccttggtactcgagacaacgaaaccgagggaaactccccctaaactcctagattagttattagtcgtcgttatagtaattaaggaaacggttcgggtacccagttacgtaaggttcacggcggacacgacctaagttcgagggacctaggtaccttcgacttcctacaacctactccaacctgttctcggacacgtccgtagacttcgtacttacgtaactaacgtttacttaccgtacgacctaaacgtacgttaaactaagttaacttttaccgtacggttacgtaaccgttacggttacccggaacgtaaacggggtaccgtaagggttaacgtaacgtaaccgaaacggtacgtcggttacggtactaccggacctaccgtacgttacgttccgttaccttaccg

SEQ ID NO: 42314 - DNA, 572 bp, Homo sapiens
  misc_feature: GYAE6OF02G4FEH.9.77.G11.1.454.CMB.1.raw
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (568)..(568): a, c, t, g, unknown or other
  misc_feature (568)..(568): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagacgtcaccatccacttgccgggcagtcagagtatgacacctgttcggcctggtatcagcaagaaaccgagggaaacacccctaaactccagtatgtattngcgttntagtattaagaagtcgggtccatcgaaggttcagcgnagacctaagtcgtagggacacgtacgttacactacctacaccacgtaccaaccgtacgttccgtgaccgacgtccgtagacgtcgtaactcgtacttaagtttactcgacaccaacataacgtagttaacttacgtacgtacgtactacgtaccggaccgaagggtaccgaagggtacgaaacgtaacaaacggtagcggtagctaggaccacgtcgttacttntacc

SEQ ID NO: 42315 - DNA, 723 bp, Homo sapiens
  misc_feature: GYAE6OF02J28F7.9.77.G11.1.454.CMB.1.raw
tcagtgatacgtctcacgaccggtgctcgatttagctagtcactcaaggggaaagggggagtcagacccagtcaggacacagcatggacatgagggtccccgctcagctcctggggctcctgctgctctggctcccgaggtgccaaggtgtgacatccagatcgaccccagtccctcccttcccaccctgtctgctattctgtaggacgacacgagtccaccatcctacgttcggcccgggtaccagtcgaggtagttaacttcggaccctacccgttcggttcggccgttaggtactacgacgaccgaaacggaaaccgaacggggaaaccctacccccttaaacgtccgtagtaattcggttaattacgtcgtacgttactaaggttaacgtaagggtaaccggttcggggtaccctagtacggtaggttaccgacgccggacacgacctacgtcgacggatacgtaccttaccgactcctaccgaccctagtacccgacctacgtcgtaacgcgtaaccgtcgtacgtacttaccgtacgtttacaacggtttaccgttacttacgaccgaacccttaaacgagttaacctagtttaacgtttaccgtacgtacgggtacctacgggaccgtaacggaagggtaacctaaggaaccggttaacaacggtaaacccgtggttacggacgtcctaccgacctactccgtttactcgtttacc

SEQ ID NO: 42316 - DNA, 718 bp, Homo sapiens
  misc_feature: GYAE6OF02H8KSJ.9.77.G11.1.454.CMB.1.raw
  modified_base (241)..(241): a, c, t, g, unknown or other
  misc_feature (241)..(241): n is a, c, g, or t
tcagtgatacgtctcacgaccggtgctcgatttagctagtcactcaagggaaagggggagtcagacccagtcaggacacagcatggacatgagggtccccgctcagctcctggggctcctgctgctctggctcccaggtcgccaagtgtgacatccagatgacccagtcctccttccaccctgtctgctatcgtgtaggacgacagacgtcacctatccacttcgacgggccagtcagatntagacactcgtggctggtatcagacaagaaaccgaggaaacgcccctaaatcctagtactagtattatggtactactaagtagttaagaaacgggtcgggtaccctagtacctaaggttcaaggccgacacgtaccgaaacgtcgtaagggactaacgtacctttacgaacctccgttaacctacaactcccgtaacctacggttccaacggctacggtacccgtaaggtacttaggtaaccgttacgtaccttaaagtttaccttaacgccgtaaaccccgtttaaagaaacggttaaactaacggtttaaaccgttttaccggttacccggtaacggttaacctaccgggtttaaccgggaaccgggaaaccgggtaacccggttaaagggtaaacggtaaaccgttaaaggaaacccgtaagttcggtacgtacggaacccgtaccgtaaccttacgttaccgttaccgtttac

SEQ ID NO: 42317 - DNA, 699 bp, Homo sapiens
  misc_feature: GYAE6OF02I9O4A.9.77.G11.1.454.CMB.1.raw
  modified_base (213)..(213): a, c, t, g, unknown or other
  misc_feature (213)..(213): n is a, c, g, or t
tcagtgatacgtctcacgaccggtgctcgatttagctagtcactcaagggaaagggggaaggtacgagaccagtcaggacacagcatggacatgagggtcccgcgtccagctcctggggctcctgctgctctggctccagtgccaagtgtgacatccagatgacccagtctccttccaccctgtctgcatctgtaggagacaggatcaacctntcaacgttcggaccgggcacgtcagtagtatcgacacctacgttcgctcggtatctagacaagaacgaaacgggtaacgacccctaaccgtaccacgatagtattatcgtacgttcagtattaagtaaaggttcgggtacctacgtctaaggtctaacggcgtacgacgacctaagtaccgttaggaccgtaagtactaccgtactcctacgacccacttaccacgtaacgtctacgtacgaccgtcgtacgtacgtcgttaccttaggtacccttaacgtttaacttacgtaccgtaaccaaccgtacgttaacaagttaaacgtttacctaaccgggttacgtaaacgttaccggtttcgaaccgggtaaccgggtaaccgtaacgggtaacggaaaaccgttaaacccgtaaaacggtaaaccgttacgggtaacccgttaggtaccggtaccctaaccggtaacttccgtaggtttaacccc

SEQ ID NO: 42318 - DNA, 727 bp, Homo sapiens
  misc_feature: GYAE6OF02F9IWF.9.77.G11.1.454.CMB.1.raw
  modified_base (333)..(333): a, c, t, g, unknown or other
  misc_feature (333)..(333): n is a, c, g, or t
tcagtgatacgtctcacgaccggtgctcgatttagctagtcactcaagggaaagggggagtcacgacccagtcaggacacagcatggacatgagggtccccggctcagctcctggggcctcctgctgctctggctcccaggtgccaagtgtgacatccagatcgacccagtcctccttccaccctgtctgcatctgtaggagacagacgtcaccatcacgttcggccgggcagtcagtagtattcgacaccgttcgtcggcctggtactcgacgcgaacgaaaccgaacgggaaccgtaccccctaaactccgtaggtacttaggttacttgngacctattacgtaagtaagtttaaggtaaacggttcggggttaccccttaggtaacggttcaacgggccggtacacgtacctaagttcgtacgggactacgtccttacgtacctctaccacctataccctacgtacgtctacgtccgacgtccgtagtacgacgtaccttacggtaactttaacggtttcttaacccgtcgtaaaccccgtaacgttaacgtaaacgttagttaaacgtttaccggtaccggttacggtaaaccttcggtttaacccgggaaccgggtaacgggtaaccggttaagttaacgggtaaaccgtaacccggtaaaacgtacgggttagaaccgtacggttaccgaccctaacggtcccgttacttacccggttacc

SEQ ID NO: 42319 - DNA, 607 bp, Homo sapiens
  misc_feature: GYAE6OF02JCMYF.9.77.G11.1.454.CMB.1.raw
  modified_base (242)..(242): a, c, t, g, unknown or other
  misc_feature (242)..(242): n is a, c, g, or t
  modified_base (594)..(594): a, c, t, g, unknown or other
  misc_feature (594)..(594): n is a, c, g, or t
tcagtgatacgtctcacgaccggtgctcgatttagctagtcactcaaggggaaagggggagtcagacccagtcaggacacagcatggacatgagggtccccgctcagctcctggggctcctgctgctctggctcccaggtgccaagtgtgacatccagatgacccagtcctccttccaccctgtctgcatctggtaggagacagacgtcaccatcacttcggcccgggaccagtcagtagtnttagacctaccttcgttcggcctggtatcagaccagaaaccgagggaaacacccctaaacgtcctaggattaggtattagtgtactactaaggtattaaggaaggttcgggtaccctagtacgtagttcgaggcggacagaccaatcggtaggacagtactacactctaccactactccacgtagtctagcacgtcctagtactcgtaccttagacgttaaacttacttacgaccgtaaccaacgtagtaacgtacgttaaagtttcgaccggttcgaactacggttaccgacgtaacgggacctaaggtaacgaaacttacgaaccgtaagtcgtacgtacacgacctacnttacccgtatacc

SEQ ID NO: 42320 - DNA, 710 bp, Homo sapiens
  misc_feature: GYAE6OF02JAM49.9.77.G11.1.454.CMB.1.raw
tcagtgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcacatcacttgccgggccagtcagagtatgacacctcgttcggcctggtatcagacacgaaaccgagggaacgacccctaaactcctagatagtattatgcgtactagattaagaaggtcgggtcccatacgtaaggttcgacggcggacacgacctaagtcgtacgggaactacgtaccttacaccgttcctaccaacctacttacccaaccgtagtacctacgaccgtacgtcctagtacgtcggtaaccttacggtaccttaaaggttttaaccttaacgttaccggaacctaaacgtaaacgttaaccttaaaggttaaaccttttaacggttaccgtacgggtaaccgttaaccggtttaccgggaacccgggttaaacggggaacccggaaaggggttaaccgggtaaaacgttaaccggaaaaccggttaaacgtcggggttaaaccggtcgttaaccggtaacccgtaacccgttattcccggttacggtttaacccg

SEQ ID NO: 42321 - DNA, 694 bp, Homo sapiens
  misc_feature: GYAE6OF02IXHH3.9.77.G11.1.454.CMB.1.raw
tcagtgatacgtctcacgaccggtgctcgatttagctagtcactcaaggggaaagggggagtcagacccagtcaggacacagcatggacatgagggtcccgctcagctcctggggctcctgctgctctggctcccaggtgccaagtgtgacactccagatcgacccagtcctccttccaccctgtctgactatctgtaggagacagagtcaccgtatcaccgttcggccggggtccagtcgaagtagtattacgacctaccgtacggttcggccgttggtactccgacgacgaaacggaaaccgaaggggaaacctaccccttaactcccgtagtacgttagtaacttagtcggtacgttactaagtagttaacggtaagggtcgggtaccctatacggtaacgttcgacggcgacgacgactaagtcgacggaacgtataccgttacctctcctaccgactacgtaccctaaccgtcgtactaccgaccgtacgtaccgtagtacgtacgttaaccggttacttacgttaacgtttacctaacgtaccgtaacctaacgtaacgttaacgtaacgtttaacttccggttacggtaccgtagtaccggttacggtaacgaacggggtacgaaggtaacgtaacgaacggtaacggtacgtaggtagtcgagtacctaaccgcttacgtctaccg

SEQ ID NO: 42322 - DNA, 618 bp, Homo sapiens
  misc_feature: GYAE6OF02F17PZ.9.77.G11.1.454.CMB.1.raw
  modified_base (301)..(301): a, c, t, g, unknown or other
  misc_feature (301)..(301): n is a, c, g, or t
tcagtgatacgtctcacgaccggtgctcgatttagctagtcactcaaggggaaagggggagtcagacccagtcaggacacagcatggacatgagggtccccgctcagctcctggggctcctgctgctctggctcccaggtgccaagtgtgacatccagatgacccagtcctccttccaccctgtctgcatcgtgtaggagacagagtcaccatcacttggcccgggcagtcagagtatgacacctgtgcctggtatcagcagaaaccgaggaacacccctaaactcctagatagttattangacatcgtagtagttaaggaaggttcggggtaccttaggtaaggttccgaggccggacgtacgaccgtaagtcggtaggaactacgtacttccactcctacacctactaccacctagttccacgtactacgtacctaggacttacgtaccttacgacttaaagttcctactacgtaccaacgtaagtactaagtttaactttacggaccgttagtacctacggttccggaacgtaaacgggtacgtaagggtaagtaaactaaccgtaaacggtacgttggacggtacgtacgaccctacgtacgttcgtcgttacc

SEQ ID NO: 42323 - DNA, 121 bp, Homo sapiens
  misc_feature: GYAE6OF01DUIYW.48.21.B10.1.454.CMB.1.raw
  modified_base (120)..(121): a, c, t, g, unknown or other
  misc_feature (120)..(121): n is a, c, g, or t
tcagagtatacatacacgaccggtgctcgatttagtgtcgtcgcaagagagatcgtgacgcagctaaatcgagcaccggtcgtgtatgtatactctgagcgggctggcaaggcgcatagnn

SEQ ID NO: 42324 - DNA, 677 bp, Homo sapiens
  misc_feature: GYAE6OF01APYXE.48.21.B10.1.454.CMB.1.raw
  modified_base (247)..(247): a, c, t, g, unknown or other
  misc_feature (247)..(247): n is a, c, g, or t
tcagagtatacatacacgaccggtgctcgatttagtgtcgtcgcaagagaggagggggaagagctgctcagttaggacccagagggaccatggaaaccccagcgcagcttctcttcctcctgctactctggctcccagacaccaccggagaaattgtgttgacgcagtctccaggcaccctgtctttgtctccgaggggaaacgccgccaccccgtcgtccgtgtagggccagtcagaatagtaagngccgacgtccttagcctggtaccagaccaaaaccgtggccgacgccctccaggcctcctcatctatcggtcgccgtaccacccgacggcccacgtcggccactcccgagaccgtaggttcacggtcggcgacggtcgggtcgtagggactagtacttcgacttccgtactacctactccaaccgagtacgtggacgtccgtagacttcggtagtttcgacgttagtttcgttttcgtgttcgtacgtcgtacgttagtacggtaaccgtttccgaacccgtaccgggtaccttacggtttcccggacccgtaacggggtaacccgtaagggtacgtaaaccgtaccgaaaaccggtacgtcggtcgtaccgtacggacctaccgtacgttccgttacgtacccgttacgtccttcccgttccccgtaccg

SEQ ID NO: 42325 - DNA, 607 bp, Homo sapiens
  misc_feature: GYAE6OF01CTQL6.48.21.B10.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggcaccctgtctttgctcgaggggaaancgccaccctntcctgtaggccagtcagaatgtaagngccactctagctggtacagacaaaactgccagcctccagctcctcatctatggtgcctccaccgacggccactggcactcccagacgtaggtcaggtggcgaggtgggtcgtgggacagtacttcacttcncacancacagactggancctagtatgttatttgacgttagttgtttttacncgttacagtacgtaagttaagttagggtaacgttccaaccggtcggtaaacttacggttccggaccggtaaccggggaacgtaagggtaacggtaaaataccgtaaaacggtaacgttggtacggaccttacggaccctaactactttcgtcgttacctttacaacctttcccggtacccctaccg

SEQ ID NO: 42326 - DNA, 598 bp, Homo sapiens
  misc_feature: GYAE6OF01B6OPA.48.21.B10.1.454.CMB.1.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctgtaggccagtcagaatgtaagagccactcctagcctggtaccagacaaaacctggccagcctccaggctcctcatctatcggtagccgtccaccagggcccacgtcggcactcccagacctaggttcagtggcaggtgggtctgggacagactcactcncaccatccacagctggacncctgatgtatttgactagtttnttttcngtcagtctagtagtggaactttcacgttcggtactacgttcgggaccgtaaggggacctaagggtagtaaaaccgtacgaaaaccggtaacgttgggtacggtaccgtacggcctaacccgtatttcccgttacggttaccctttacctaactttccccgttccccgtacccg

SEQ ID NO: 42327 - DNA, 550 bp, Homo sapiens
  misc_feature: GYAE6OF01DHJ5W.48.21.B10.1.454.CMB.1.raw
  modified_base (204)..(204): a, c, t, g, unknown or other
  misc_feature (204)..(204): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgagggaaanccgccaccctctcctgtacggccagtcagaatgttaagagccactcctagcctggtaccagacaaaaactggccagcctccaggctcctcatctatggtgccgtccaccgacggccacgtggcactcccagacagttcagtgcaggtggtctgggacagactcactctcaccatccacacgactggacgcctgatgtattttgactagttgttttcngtcagtctagtagtaggtaatcacgtacggactacgttcggacgtacgggaacctaaggtagtaaactacgaaacgtagtggtggactggcaaccgtagttccgtagttacttgacttccgtcccgtac

SEQ ID NO: 42328 - DNA, 910 bp, Homo sapiens
  misc_feature: GYAE6OF01BBFI7.48.21.B10.1.454.CMB.1.raw
tcagagtatacatacacgaccggtgctcgatttagtgtcgtcgcaaggaggaggagggggaagagctgctcagttaggacccaggagggtaaccatggaaaccccagcgcagcttctcttcctcctgctactctggctccagacacaccggagaattgtgttgtacgtcagtctcctaggcacctgtcttgtctcgaggggaaacgcgcctaccgtcgtccgtggtacggggccagttccgaggtaaaggttcggttaaagacgcctacctccttacggccgttggaccaacgtaccaaaaccgtggacctacgcctaccacggcttcctcactcgtagtcggttcggccgtaccgaccggacgggcccgaacggtcgggcacgtacccgaggtacgtacgttctaaggtcggacgtaggtcgggtacgtacgggtacgtacgtacttactaaccgtctaccgaaccgtactaccgaggtaccgtaacgggtcccttacggaaccgttacggttaccgtaacggggtaaaaccgtttaaacgtttttaaacccgttaaatttttaaaccggttttaaccttaacgggttaaacccgttaaaggtacccgttaaaggtttaaacggtttacccgggttaaaagggtttacccgggttaaacccggtttaccgggttaaaccccgggttttaccgggggaaacccggttaaaaaccggggggtaaacccggttaaaaccggggttaacggggtaaaaacccggttaaccgggttaaaaaccggtaaaacggggtttcggttaaccggggaacgttttcccgggaacccgttaaaacgtcccggtttaccgtttaacggttacccgtttaacccggtaaggtttacccccgtacccgggtccgttaaaaccgg

SEQ ID NO: 42329 - DNA, 761 bp, Homo sapiens
  misc_feature: GYAE6OF01DAD5T.48.21.B10.1.454.CMB.1.raw
tcagagtatacatacacgaccggtgctcgatttagtgtcgtcgcaagagaggaggggggaagagctgctcagttaggacccagagggaaccataggaaaccccagcgcagcttctcttcctcctgctactctggctcccagacaccaccggagaattgtgttgacgcagtctccaggccaccctgttctttgtctccgaggggaaacgccgcccaccctctccgtggtacgggccagtcagtaatagttaagacgcctacttccttagccgtaggtaccagaaccaaaaccgtcggaccacgccctacccgacggtcctcctacacttctagtcggtcgccgtacccgaccgacggccacgtcggccactcccgagacgtaggttacgaggtcggcgtaggtcggggtcgtacggggactacgtacttcactctaccaacctactaccaaccgacgtacgtacggacgtcgtagtagttagttagtttcgtacgttacgttttgttttcgttcgttacgtactacggggggggggggggggggggggggggggtattaggttacggttacgttaccgtaccgttaccggtaccgttacggttaccgggtaccgggtaaccggggtaaccgggtaacgggtaacggtaaacgtaaccggtaaaccggtaacgtacgggtacgggtacggtaccggtaccgtaaccgtacgttaccgttaccgtttaccgtttaccttaccgttacccgttccccggtacccg

SEQ ID NO: 42330 - DNA, 603 bp, Homo sapiens
  misc_feature: GYAE6OF01E0GYC.48.21.B10.1.454.CMB.1.raw
  modified_base (203)..(203): a, c, t, g, unknown or other
  misc_feature (203)..(203): n is a, c, g, or t
  modified_base (477)..(477): a, c, t, g, unknown or other
  misc_feature (477)..(477): n is a, c, g, or t
tcagagtatacatacacgaccggtgctcgattttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctcaggcaccctgtcttgctccgaggggaaanccgccaccctctcctggtacgggcccaggtccagaatgttaagacgcctactccttagcctaggtaaccagacaaaaaccgtcggaccacgcctcccgaggcctccgtacactctagtcggtcgccgtaccaccgtacgggccacgtcggactactacccgacgtacgtacggttcaggtcggcgtaggtcgggtactgggaacagtaccttcgactctacacctatacacgagacgtggacgtcctgatgtatttgctagttgtttctgtcgngtactagtcgtagtacgttcacgtcggactgttcggacgagggacaaggtgaaactacgtaaacgacgtggtaccgtagtacgtccacgtcgttcgtacgtaccttataccttccgttcccgtacg

SEQ ID NO: 42331 - DNA, 815 bp, Homo sapiens
  misc_feature: GYAE6OF01EEOF0.48.21.B10.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccgaccggagtaaattgtgttgacgcagtctccaggcaccctgtctttgctcgaggggaacncgccacctctccgtgtacggcagtcagtatagttaacgngcctacttccttagccgttacggtaaccagaccaaaaaccgtggaccacgccctccaggtcctcctacactcgtagtcggtcgtccgtccaccggacgggtaccacgtcggaccacgtcccgaagtaccggtacggttacgacggttcggacgtacggttcggggtcgtaggggacctacggtaccttccgaacgttcctacccgtaacctacgttaccgaaccgtacggtaccgtacgggtaacgtcccgttaaggtaacgttacgtttaaacgtttttcggaaccgtttaacgggtttttcggttttttaccgtacgggttacgtacgttacggtaaccgtttaggttaaccgggttaacgtttccggtaacccgttacgggtaacccgtttacgggttacccggggaacccgttaacggggggtaaaccccgtaaggggttaaacggtaaaaccggttaaccggaaaaccggttaacggtttacgggaccggttacgtacggtacccgtaaaccgttcgttaaccgtttcgttacccgttacgtaccgtttccccgttaccggtaccc

SEQ ID NO: 42332 - DNA, 717 bp, Homo sapiens
  misc_feature: GYAE6OF01A0WYO.48.21.B10.1.454.CMB.1.raw
  modified_base (209)..(209): a, c, t, g, unknown or other
  misc_feature (209)..(209): n is a, c, g, or t
  modified_base (715)..(715): a, c, t, g, unknown or other
  misc_feature (715)..(715): n is a, c, g, or t
tcagagtatacatacacgaccggtgctcgatttagtgtcgtcgcaagagaggagggggaagagctgctcagttaggacccagagggaaccatggaaaccccagcgcagcttctcttcctcctgctactctggctcccagacaccaccggagtaattgtgttgacgcgtagtctccaggccacccgttgtcttcgtctaccgagggaacnccgacctaccctctccgtgtacggccagtcagtaatgttaagcgcctacttccttagccctaggtaccagaaccaaaaaccgtcggacccaacgcccgttaccgaggtcctcctacacgtctacgtcggtacgtccgtaccctaccgacggtcccacgtcggactaccgtcccgaagacgtacggttcacggtcgccgtaggtcggtcgtagggtaccagtaccttcaccgtcgtaccacctacgtccaaccgacgtaccgtcgggtaacgtcccgtaggtaccgttggtttaccgtttttacggaccgtttaaggttttccttttaccggtagtttacgacgttagtacgttgtacggtaccttcgtaccgtaggtcgtacgttaccgggacggttaagggaccgttaagggtaccgtaagtaaccggaaacgttaacgcggttacggtccacggtccgtacccaagttcgtaccgttccttacgccgtttcccggttaaccccncg

SEQ ID NO: 42333 - DNA, 604 bp, Homo sapiens
  misc_feature: GYAE6OF01D3WS3.48.21.B10.1.454.CMB.1.raw
  modified_base (200)..(200): a, c, t, g, unknown or other
  misc_feature (200)..(200): n is a, c, g, or t
  modified_base (381)..(381): a, c, t, g, unknown or other
  misc_feature (381)..(381): n is a, c, g, or t
  modified_base (559)..(559): a, c, t, g, unknown or other
  misc_feature (559)..(559): n is a, c, g, or t
tcagagtatacatacacgaccggtgctcgattttagtgtcgtcgcaagagaggagggggaagagctgctctagttaggaccagagggtaaccagtcggaaacccagcgcagcttctcttcctcctgctactctgctcccagacaccaccggagaaattggtgttgacgcagtctcagcacctgtctttgtctcagggaancgccacctctcctgtaggcctagtcagaatgttaagacgcctactccttagcctagtaccagactaaaacctggccacgcctcccagcctcctctatctatggtcgccgtccaccgacgggccacgtggccacgtacccgaagacgtacggttcaggtcgacgtaggttggtcgtcggganacgtacttcactctacaccacgtaccaacagtacgtacggacgtcctagtatttacgtattttcgagttagttttctttttcgtgtcagttactaggttagtacggtaacttccgacgttacgactacgttcggaccgaagggtaccaaggtacgaaataacgaacgtaagtgtacgngtacgccaacttcgtcttcgtaccttactaccttcccgtccctac

SEQ ID NO: 42334 - DNA, 928 bp, Homo sapiens
  misc_feature: GYAE6OF01APVAQ.48.21.B10.1.454.CMB.1.raw
  modified_base (207)..(207): a, c, t, g, unknown or other
  misc_feature (207)..(207): n is a, c, g, or t
tcagagtatacatacacgaccggtgctcgatttagtgtcgtcgcaaggagaggagggggaagagctgctcagttaggacccgagagggaaccatggaaaccccagcgcagcttctcttcctcctgctactctcggctcccagacaccaccggacgtaattgtgttcgacgcagtctccaggccaccctgtcttgctccgagggaacncgccacctctccgtgtacggccagtcacgtaagtcgttaagacgacctacgtccgttacgccgtacggtaaccaacgtaccgaaaaaaccgtcggtacctaaccgacccgttacccgacgggtaccttccgtaccgtaaccgttccgttaagtcgggttacggtcccgttacccgaacccgaccggggtaccctacggttaccggacctaccgttacccgaacggtaaccgttaacggtttaccggtaacggttaccgggaccgttaaacggggtttccgggttaccggtaacgggggtaaacccgtaacggttaacccgtttttacccggaaccctttaacccggttacccaaacccgttaaccgttacccgaaacccgtaacggttacccgtaccgggtaccgtaacccgtttaggtaacgttcggtttaacttttacgggtaccgtttacggtttttccggttttaccgtacggttacgtaacggttacgttaaacgttcggttaacggttaaccgttcgtaacccggttacgaaccgggttacgtttacccgggaccgggttaacgggtaacccggttaacgggtaaccggtaaacgttaaccggtaaaaccggtaacggttccgggtaccggacgtttaaccgggcctaaccccgtaaggttttcccgtacgttacccgtttacccgtaacgtttcccccgttaaacccgtcccgg

SEQ ID NO: 42335 - DNA, 803 bp, Homo sapiens
  misc_feature: GYAE6OF01DOCDH.48.21.B10.1.454.CMB.1.raw
  modified_base (221)..(221): a, c, t, g, unknown or other
  misc_feature (221)..(221): n is a, c, g, or t
  modified_base (530)..(530): a, c, t, g, unknown or other
  misc_feature (530)..(530): n is a, c, g, or t
  modified_base (554)..(554): a, c, t, g, unknown or other
  misc_feature (554)..(554): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggcctcccagaccaccaccggagtaaattgtgttgacgcacgtctaccacggcctacccttgttctttcgtcgtaccgaagggggaaacnccgaccctaccctctccgtggtacggccagtacaagtaatgtaacgacgcctacttacgttagccttaggtaccagaaccaaaaccgtcggaccacgtccctacccgacggtcctacctactactacgtagtcggtacgccggtacccgaccggaaccggtccctacggtcggccaacgtaccccgaaggtaccgtacgggttccaaggttcggacgttaggttcgggtacggtagggaacctagtaccttccgtacttcgtaccacctactaccgaaccacgtacgtcggtacgtacgtagtacgttnttagtttccgtagtttacgttttnttttaccgtgtaaccgtagttacgttaaggttacgttaggttaacgtttacccgtaccggttaccgggtaaccttccggggtacccgggtaaaccgggtaacggggtaaaccgttaacggggtaaacgttaaaacgaacccggtaaaaccgttacggtacgggttacccgacggttaaccggacccgttacctacgttaccggtttacttacgtttaccccgttacgtttaccccggttccccctaacg

SEQ ID NO: 42336 - DNA, 743 bp, Homo sapiens
  misc_feature: GYAE6OF01BU7PL.48.21.B10.1.454.CMB.1.raw
  modified_base (208)..(208): a, c, t, g, unknown or other
  misc_feature (208)..(208): n is a, c, g, or t
tcagagtatacatacacgaccggtgctcgatttagtgtcgtcgcaaggagagagggggaagagctgctcagttaggacccagaggaaccagtggaaaccccagcgcagcttctcttcctcctgctactctggctccagacaccacggagtaattgtgttgacgcagtcctcgaggccacccgtgtcgtttgccgtccggaagggaacnccggaccctacccgttctccgtggtaccggcctaagtccaaggtaattacggttaacgaccgtacccgtaacgtttccgttacggacccgttacggtaaccacgtaaccgtaaaccgtcgacccgaccgtacccgtaccgacgtcctaccgtacgtacgtcgtacgtcggtcgaccgtacccgacggaccggaccgtacgtcgtaccgtacgtaccgtacgtacgtacgtacgacggtcgacggtaggtcggtacgtacggacgtacgtacgtacgtacctcgaccgtactactaccgacgtacgtacgtcgacgtcgtagtacgttcgttacgttacgtacgtttagtttcgtttcgtacgtacgtacgtagtagtacggttacgtaccgttcgtaccgtacgtacgttaccgggtacgtacggtaacggtaacgtacggaacgtaacgtaccggtaacgtacgtacggtcgtaccgtacgtacgtaccgttacgttccgtaccgttactaccgttaccgtcccgtaccgtacg

SEQ ID NO: 42337 - DNA, 747 bp, Homo sapiens
  misc_feature: GYAE6OF01EQNIV.48.21.B10.1.454.CMB.1.raw
  modified_base (209)..(209): a, c, t, g, unknown or other
  misc_feature (209)..(209): n is a, c, g, or t
  modified_base (593)..(593): a, c, t, g, unknown or other
  misc_feature (593)..(593): n is a, c, g, or t
tcagagtatacatacacgaccggtgctcgattttagtgtcgtcgcaaggagagagggggaagagctgctcagttaggacccagagggaaccatggaaaccccagcgcagcttctcttcctcctgctactctcggctcccagacaccgaccggagaattgtgttgacgcagtctacgaggcacccgtgtctttcgctccgaggggtaacnccgcctacctctaccgtgtacgggcctaaggtctaaggaattgttaaacgcgtaccctacgtcttacgccgttacggacaacgacaaaaccgtcgaccacgcctccgacgtcctacctcacttcctagttacggtcgtccgtacccgaccggtacgggtaccacgtcggcctaccgtacccgagtaccgtaacggttcacggtcgtccgaggtacgggtacgtacggggactacggtacttacacgtccgtaccgactaactccgaaccgtacgtacgacgggtacaccgttaggacttggttaacgttttcgacgttaacggttttccgttttagcggtttacacggttcggtaacgtaacggtttcgtaggttttaaccccnggttacccggggtaactacgggtttacccgggaccttaacggggtaccgtaaaggggtcgtaaaaccggactaaacgggtacccttggggtacgtacgtacgtcccacgttactccggttaacgttccttaaccgtacttccccgtttcggacc

SEQ ID NO: 42338 - DNA, 827 bp, Homo sapiens
  misc_feature: GYAE6OF01CI2OL.48.21.B10.1.454.CMB.1.raw
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccagcaccctgtctttgtctaccgaggggaacgccgcccaccctctccgtggtacgggccagtaccagtaagtgttaacgacgtcctacttaccgttacggccgttacggtaaccaagaaccgtaaaaaccgtcggacccacgtccccgtacccgtacggccttccctactacgttccgtagttcgggtcggtcccgtacccgacccggtacgggacccgaccgtaccggtacctaccgttaccccgaaggtaacccgtaggttacgtaagggttcggaccgtaggttccgggtacggtacgggacgtacgactttaccgacgtccgttacccacgtacctacccgaaccgacgtccggttacggtaccgtaccgttagtaaacgtttcgtttaaacgtttacggtacgttttaccggtttttaggttttccgttaagtcccgtaacggtaccgttaagggtttaacgttacggttaacctttacccggtaacccgttaccggtacgttaccgggtaccgggtaaccgggtaaacgggtaaccggtaagggtaacgtaaacgtaccggtaaaacgtcgttacgggtacgtacgtaccgtaccgttaccgtcgttacgttaccgtacttaccggttcttaccccgtcccgttaacg

SEQ ID NO: 42339 - DNA, 823 bp, Homo sapiens
  misc_feature: GYAE6OF01A9HF4.48.21.B10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctgggctcccaggacaccaccggagaaattgtgttgacgcaagtctccaggcaccctgtcttgctcgaggggaancgccgaccctctccgtgtacggccagtcagatgtagngccactctagcctgtacagcaaaactggcagcctccagctcctacatctatcggtcgccgtcacgtacgggcctacgtggcagtcccgaggaccgtacggttacgaggtcggccgtaacggttcgggacgttcggggaaccgtacggtaccgttcgaaccttccgtaccctaacctacgttacccaacccgttaacgaaccgtttcgggaaccggtaccgttagtaacgtttacggttacgttttacggtacgttaaggtttttacggtttttaccgtaacggttaacgttaacggtaccgttaaggtttaaacggttacgggtttaaaccgttttaccccgtaaccggttaacccgggttaacccgtaaccgggtttacccgggggtacccggtaaacgggggggtttaaccccgaaaacggggggtttaaacggttaaaaccggttaaacccggtaaaacccgggttaaaccggttacgggttaacggttacggttaacccgaacccggtacccgtaaggtttacccggttacgtttaccggttacccctaccggtttaccccgttcccccgggtaaccg

SEQ ID NO: 42340 - DNA, 726 bp, Homo sapiens
  misc_feature: GYAE6OF01C5PLC.48.21.B10.1.454.CMB.1.raw
  modified_base (153)..(153): a, c, t, g, unknown or other
  misc_feature (153)..(153): n is a, c, g, or t
  modified_base (210)..(210): a, c, t, g, unknown or other
  misc_feature (210)..(210): n is a, c, g, or t
  modified_base (592)..(592): a, c, t, g, unknown or other
  misc_feature (592)..(592): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactcgtggctccagaccaccaccgganaaattgtgttgacgcagtctccgaggcctaccctgtctttgtctaccgaggggaacnccgacccacccttcgtccgtggtacgggcctaagtcaagtaatagttaagacgcctaacttcgttacgccgttaggtaaccagaaccgtaaaaccgtcggaccgacgtccctaccgacggtcctcctacgtacttacgtagtcggtcgccgtaccgaccgtacggcctacgtacggacctaaccgtacccgaggtacgtacggttacgaggtacggcgtaacggtcgggacgtacgggtactacgtaccttaccgtacttaccgtacacccgtaatacccgacacgtaccgtgaccgtcgtacgagtttacgttagtttcgacgttaacggtttacttaacgttcttacgtacgtacgtacgtaagttaggtaccggttacnccgtaaccgttaccgtacgttacccgtaaccggttcgggaaccgaacgggttaccaacggtagtacgggaagttaacccgttaacggtacgttcggtacgctacgacctacgtatccgttacttccgtcttccg

SEQ ID NO: 42341 - DNA, 593 bp, Homo sapiens
  misc_feature: GYAE6OF01A76N5.48.21.B10.1.454.CMB.1.raw
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (443)..(443): a, c, t, g, unknown or other
  misc_feature (443)..(443): n is a, c, g, or t
  modified_base (530)..(530): a, c, t, g, unknown or other
  misc_feature (530)..(530): n is a, c, g, or t
tcagagtatacatacacgaccggtgctcgatttagtgtcgtcgcaagagaggagggggaagagctgctcagttaggacccagagggaaccatggaaaccccagcgcagcttctcttcctcctgctactctggctcccagacaccaccggagaattgngttgacgcagtctccaggcaccctgtctttgctccagggaacncgccacctctcctgtacgggccagtcagaactgtaangccatcctagctgtacagcaaaactgcagcctccagctcncatctatgncgtccacaggccacgtgcatcccagacagttcagcgcacggtggtctgggacngtacttcgactcgtcacctagttccacacggtactcgggatccgtagtactgtacttttagctaggttatttttccgagttccagtctaggtatcggaagttcnccgtcggtaacctgttacccggtaccggacgggtactaacggttaacggaactacggtaaaaccgtaaaggttcggtacgggttacncgggtaacccaccgtttaagtccgttaccgttactttaccgactttccccgtacccggttccc

SEQ ID NO: 42342 - DNA, 929 bp, Homo sapiens
  misc_feature: GYAE6OF01D8ZNP.48.21.B10.1.454.CMB.1.raw
tcagagtatacatacacgaccggtgctcgatttagtgtcgtcgcaaggagaggagggggaacgagctgctcagttaggacccagaggaaccatggaaaccccagcgcaacgcttctcttccctcctgctactctggctcccagactaccgaccggtagtaaattgtgttagtacgtacgtagtcctccgaggcctacccgtgttctttcgtccgtaccggaaggggtaacgcccgtcccgtaacccttccgttccggtacggtaacggggccctaacgtaccgaagtaaacgttcggttaaacgccgtaccccaccgtttacccgttaacggtccccgtttacgggtaaacccctaacggtaaacccgtaaaaaacccggttcggacccctaccggtccccgttaccccggtaacgggtccctccctaccgtaacgttccgttaacggttccgggtaccggtacccggttaccccggtaacccgggtaaccggggtaccccttacgggtaaccggtaccgtaaaccggttaacccccggaaggttaaacccggtacgggtttaacggaacgggtcgggtaaccgtagggtttaccggggtaccgtaacgggaaccgtacggtttaacccgttaccgtaaccgttacccgtacctacctaaccgtacccgtaaccgtaagtaccgtacgggtaccgtaccgttagtacgttacgttaagtttcgtacgtttaggttttacgtttacgttacgtcgaacgttacgtaacgttaacggttcggtaacgttccggtaccggtacgtaccggtaaccggttcccggtaacggttaacggtaacgtaggtaacgtaaccgtacgtaaacgtacggtcggtacgtcacggtaccgtcgtacttccgtcgtaccttactcccgttccgtcccgtacg

SEQ ID NO: 42343 - DNA, 603 bp, Homo sapiens
  misc_feature: GYAE6OF01CBKRY.48.21.B10.1.454.CMB.1.raw
  modified_base (171)..(171): a, c, t, g, unknown or other
  misc_feature (171)..(171): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagaggaggggggaagagctgctcagttaggacccagagggaaccatggaaaccccagcgcagcttctcttctcctgctactctggctccagacaccaccggagtaaattgtgttgacgcagtcnccaggcacctgtcttgctcgaggancgcacctncngnggcagtcanatgtagnccactctagctgacagacaaacgtgaccngccnccgagctccgtnatctangtcncgtaccaccgacggcccacgtgactacgtcccgaagccgtaggttccaggtcggacgtggtcggtcgtagggacgacgtacgtccactctacctacctacacctacgacgtacgtacggtacgccgngtattggtatttcgngttacgtttgttttgtacggttgaccgttgtaaggtagtacgttaacgttacggaccttagggtcgtaggttcccggaggaacggacgtaacgggaacttaagaaccggtaaactacggtacgtcggactcgaaccgtccgtatcggtttacctcttaccgtaccttcggtaaccctacccg

SEQ ID NO: 42344 - DNA, 878 bp, Homo sapiens
  misc_feature: GYAE6OF01A06PR.48.21.B10.1.454.CMB.1.raw
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagcagccaccggagaaattgtgctgacacagtctccacgcctaccctgttccttgtcctccgagggcaaacgcgccctccctctcctgcgacggccagtcagctatgttacgcctacctacgttacgaccgtacggtaaccaaaacgtaaacgccggtacggaccgaaccggcccgtaccccgacgtacccttcccctactacgttcgtaactacgtacgtcggtaccgtaccgtaacccggacgggtcctacggtccgggtacccggtccccgggtaccgtacggttaccgacgtccgggtacgtacggggttcggtaccggtacggggtaacctaacggttaccgttacccaccgttacccgtacctaaccgtacgtccggaaccgacccgttacgacccggtaacggacccggtaaacccggttaaggttttacggttttaccgggttacgtttttaaacgttaccgttacgggttacccgtacgggttacgtacccggggtacttaaccccggtaaccggttacccggtacccggttacccccgttaccggtttaacccggggttacccggggttttacccgggggaccgggggtaaacccggacggggttaaccgggtaccgaaacgttaaacccggtaaccgtaaacggttaacccgggttgggacccgaggtttacccgacccggtttaaccgtaccggttacgtttccgtttaccccgtcggttaaaccccg

SEQ ID NO: 42345 - DNA, 811 bp, Homo sapiens
  misc_feature: GYAE6OF01B472I.48.21.B10.1.454.CMB.1.raw
  modified_base (178)..(178): a, c, t, g, unknown or other
  misc_feature (178)..(178): n is a, c, g, or t
tcagagtatacatacacgaccggtgctcgatttagtgtcgtcgcaagagaggagggggggaagagctgctcagttaggacccagagggaaccatggaaaccccagcgcagcttctcttcctcctgctactctggctcccagaccaccaccggagaaattgtgttgacgcagtctccgnggcaccctgtctttgtctccgaggggaagccgccaccctctccgtgtagggccagtcaagaattgtaagacgaccactccttacgcctaggtaaccaacgaaccaaaaaccgtcggacccaaccgtccccgtaccgaccggtccttaccctacattccttagtcgggtcgtccggtaccgaccggtacggcccgtagtccggacctacctacccgaaggaccgtacggttacgaggtcggacggtacggttacggggtacgtacggacgtacggttacccttacgtacctttaccaccctaaccctaacgtacccaaccggtacggtaccgtacgggtccgtaacgttgtactttaggttaccgtttacggtcgtttacggttttgttttaccgttacgtaacggtactaacggttaggtttaacgttaagggttaccccgttaacgtaacccggttaacggtacccggttaccgggttaccggggtaaccccggttaaagggggtaaccggtaagggttaaacgggaaaacccgtttaaccgaaaccgggtacgttacggtcccggtacgtacgaccccgttactacggttccgttacggttaccctagtttacccttcccggtcctacccg

SEQ ID NO: 42346 - DNA, 811 bp, Homo sapiens
  misc_feature: GYAE6OF01DGWIK.48.21.B10.1.454.CMB.1.raw
  modified_base (205)..(205): a, c, t, g, unknown or other
  misc_feature (205)..(205): n is a, c, g, or t
  modified_base (767)..(767): a, c, t, g, unknown or other
  misc_feature (767)..(767): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagaccaccaccggagtaaattgtgtgacgcagtctccaggcacccttgtctttgctcgaggggaacnccgcccaccctctccgtggtacggccaggtaccagtaaacgtggttaagacgccctaacttccgttacgacccgtacggtacccaagtaaccaaaaccggtcggaccaaccgtccctacccgacggtcctccctactatcgtagtcggtcgccgtccacgtacggcctacgtcggacactacccaggaccgtaggtaccgaggtcgggtacgtcggttgggtaccgtacgggtactacggtacctttaccgaaccgttcctaccgtacccgtactacccgtaaccgtaacggttaccggtacgggtaaccgtcccggttaagttaccggtttacggtttaacgttttcggtaaccgttttacggtttttacgttttttaccggcgtttaaccgtaacgtcgttaaaggttttaacgggtaccggttaaaccgttttacccgtaacccggttaccggtaaccgttaaccggggttacccgggtaaaccccgggtagggtaaacccggtaggggtaaacctaaaccgtaaccgtaaaccggtgtacgggttacgccggttaacnccgtactcgtaccttcgttacttacgtccttccgtacccgtacg

SEQ ID NO: 42347 - DNA, 691 bp, Homo sapiens
  misc_feature: GYAE6OF01DVQ1D.48.21.B10.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (604)..(604): a, c, t, g, unknown or other
  misc_feature (604)..(604): n is a, c, g, or t
tcagagtatacatacacgaccggtgctcgatttagtgtcgtcgcaagagaggaggggggaagagctgctcagttaggacccagagggaaccatcggaaaccccagcgcagcttctcttcctcctgctactctggctcccagacaccaccggagaaattgtgttgacgcagtctccaggcacctgttctttgctcgagggaanccgccaccctctcctgtacgggccagtcagtaattgtaaagcncccatccgttagccttaggaccagacctaaaaaccgtgaccacgccgtacccaggtcctcctcctatcctagtggtcgcctaccgaccgacggccctacgtggacctactcccgaagacgtacgttacgagtcggacgtaggtcgggttacgtaggggacacggttacttacgacctacgtaccaacccgattaccgacctaaggtcggtacggacctaccgttaggaacgtttagttttacgaacctttaaagttttacgtacccttacggtaacctaaccgttaagttacggttcggtagtaccctacgttaaccttacgttaacgtttacggacgggtagtaccggtaagtcgganaccgtaaacgtaaccgtaagttggaccgtacgacgtactcgttactcgttacgtaaccgttacttcgttacccctcccgtcttaacg

SEQ ID NO: 42348 - DNA, 684 bp, Homo sapiens
  misc_feature: GYAE6OF01DE91H.48.21.B10.1.454.CMB.1.raw
tcagagtatacatacacgaccggtgctcgatttagtgtcgtcgcaagagaggaggggggaagagctgctcagttaggacccagagggaaccatggaaaccccagcgcagcttctcttcctctgctactctggctcccagaccaccaccggagtaaattgtgttagacgcagtctccgaggcacctgtctttgctccgaaggggaactccgcctacctctcgtggtacggccagtcagtatgtaagacgccacgtctagcctaggtacagacaaaactggaccagcctcgacgtcctctcatctagtcggcgtctccacgcggctacgtcggcacgtccacgcgtaggttcacggtggaccgtaggtcgggtcgtggaacaagtccttacgaccttcaccactaacgtccaacgttacgacgtcgacgcgttagacgttacgtagtttacgtacggttaagttttcggtttaactcggttaacacgtacggtacgttaacgttagggtaacttcccgtaaccggtacggtaacgttaccgggtacccgggtaacggtaaaccgggtaacggttaaggtaaaccggtaataccggaaaaacggtcgtaggttacccggcttaacgacccttacgtaacgttcgtaccgtttaccttactaaaccccggttccctacccgttaacgg

SEQ ID NO: 42349 - DNA, 805 bp, Homo sapiens
  misc_feature: GYAE6OF01DGYC0.48.21.B10.1.454.CMB.1.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (502)..(502): a, c, t, g, unknown or other
  misc_feature (502)..(502): n is a, c, g, or t
  modified_base (785)..(785): a, c, t, g, unknown or other
  misc_feature (785)..(785): n is a, c, g, or t
tcagagtatacatacacgaccggtgctcgatttagtgtcgtcgcaagagaggaggggggaagagctgctcagttacggacccaggagggaaccatacggaaaccccagcgcagcttctcttcctcctgtctactcgtcggcctcccagaccaccgacggaagtaagttcgtgttacgaccgcgtacgtccnccgaggcctaccgtcgttctttcgccgtaccggaaggggaaccnccgaccctacccgtcgtccgtcggacggcctagtacgaagtaacgtacggtaacgaccgctacctaccgtacggccgtaacggtacccaagaaccaaaaccgtcggaccgtacgtccctaccgacggtcctaccgtcacgttcgtagtcggtcgacccgtaccgccgaacggtccacggtacgtaccaccgacgtacggtaccgtagtcgacggtggtaccgtacggtcggttacggacggtaacgcgttaccgtacctcgtacccnccgtaaaccgccgtaaccgacggtacgtacggtaccggacgttaccgtgttacgtacggtttcgttacggtttaaccgttggtttttaccgtttacggtacgttaccgggttagtaaccggtaaggtttaaacggttcggtaacccgtacggtaccccggttaagtaccgttacccggtaccggacgggtaacgggtaaccgagtaaccggtaaacgacgtaaaccggtaggttcggccggaacctgtaaccccggtgtaaccgttccgtattacccgttacncccgtttacccggcccttcg

SEQ ID NO: 42350 - DNA, 617 bp, Homo sapiens
  misc_feature: GYAE6OF01CRQEV.48.21.B10.1.454.CMB.1.raw
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagacaaaacctggccagcctcccaggctcctcatctatggtcgtccgtccaccgagggcccacgtcggcactcccagacaggttcaggtgcgaggtgggtcgtgggacagtacttcactctcacctactccaccagcgtacggacgcctgacttgtattttcgacttagtttgtttttctcgttcacgtacgtaagttagttaggtaagttccgaccgttacggacgttacgttccgggaccgtaacggggaaccgtaagggtaacggtaaactaccgtaaaacggtacgtaggtcggactacggaccaccgtaagttccgtacttacccttagtaccttccgttccccgtacc

SEQ ID NO: 42351 - DNA, 808 bp, Homo sapiens
  misc_feature: GYAE6OF01BZ8Q1.48.21.B10.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagagtatacatacacgaccggtgctcgatttagtgtcgtcgcaagaggagagggggaagagctgctcagttaggacccagagggaaccatggaaaccccagcgcagcttctcttcctcctgctactctggctcccagacaccaccggagaaattgtgttgacgcagtctccaggcaccctgtctttgctcgaggggaacncgccacctctcctggtacggccagtcagaatgttaancgcctactccttagcctggtaccagacaaaacctggccacgcctccaggcctctacatcctatcggtcgcgtaccgaccgacgggtcccacgtggacctactacccaagtactaggttaccaggttcggacgtacggtcgggtcgtaggggacctacggtaccttaccgaaccttcctaccgaaccctacgttacccaaccgaacggtaacccgttgggaaccgtcccgttaggtaacgtttggttaactttttacggaccggtttaaacggtttttcggtttttttccgaggtttacccgaggttaaccccgtaagggtttaagtttaccggggttaaaccttttccggtaaccccggttacgggttaacccgttacggttttacccggggaacccgggtaaacggggggtaacccgtaaaagggggttaaggtaaaacccgtaacggtaaaacccggttaacggttaccggggttaaccgggaccgttacgggaaccctaaaccggtaaccgtttccgtttaccggtttacttacccgttaaccgttccccgttaccccggtaaccc

SEQ ID NO: 42352 - DNA, 816 bp, Homo sapiens
  misc_feature: GYAE6OF01DB741.48.21.B10.1.454.CMB.1.raw
  modified_base (216)..(216): a, c, t, g, unknown or other
  misc_feature (216)..(216): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctcgctcccagaccaccaccggagaattgtgttgacgcagtcctccgacggcctaccctgttctttcgtcctaccggaaggggaacnccgaccctaccctcctccgtacggtacgggaccacggtactaagtaacgttagtaacgacgccctaacttccttagccctggtacctaacgaactaaaaccgtcgaccacgccctccgacgtcctacctctatcgtacgtgtccgaccgtccgtaaccggcggaccgtacgtcggacctctccgaagtacgtacgttcgaggtcgcgtaggtcggtacgacggactacgtactcnccgtccacncctactaccacgtacggtacgtacgaccgtacgtagtagtttacggtttagtttaccggttacgttttacggtttacgttttaccgtcggtaacgttaacggttcgtttaaggtttaccggtacggtttaaccgttacccggttacccgtaaccggttaaccggttaccgggttaccgggggaaccccggtaaacgggttaaccgggtaagggttaacggtaaaccgtaaaccggttaaacggttcgggtaaccgggtttggacccgtttaaccggccccgttaaacgttaccgttttcccgttaaccggttacctttaacccccggtcctttttacccccggcccgtttaaacgg

SEQ ID NO: 42353 - DNA, 744 bp, Homo sapiens
  misc_feature: GYAE6OF01BECYO.48.21.B10.1.454.CMB.1.raw
  modified_base (201)..(201): a, c, t, g, unknown or other
  misc_feature (201)..(201): n is a, c, g, or t
  modified_base (566)..(566): a, c, t, g, unknown or other
  misc_feature (566)..(566): n is a, c, g, or t
  modified_base (720)..(720): a, c, t, g, unknown or other
  misc_feature (720)..(720): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccacggagaaattgtgttgacgcagtctcaggcaccctgtctttgctccgagggaacncgcccacctctccgtgtacggcctagtcaagaagttagttaagacgcctacttccgttagcccgtaggtaacccagaccaaaaaaccgttcgggaccacgacccttcccgacggtacctccctcaacttactaccgtgggtacgccgttacccaaccggtacgggaccctacgtcggaccgtacgtaccccaagaccgtaggttccgaaggtcggactcggttacggggttcgtacggggacaacggtaccgtttaccgaccgttccgtaccacccgtaactaccgaaccgaacggtaccgtacgggacctccgtagtaagttaggttacttttacggactttaaggtttcgtttttatcggtanacgttacgagttaagtcgtaacgtctacgtacgtaacgtgttaccggaccggtaacggggtaactaagggtaacgaaacgtaccgtaaacggtaaacgttcggtacggaccgttaggtacccaaccttcgtaccttccggtaacccggtttacncccgtttaccgcccgttaaccccg

SEQ ID NO: 42354 - DNA, 818 bp, Homo sapiens
  misc_feature: GYAE6OF01BC1XS.48.21.B10.1.454.CMB.1.raw
  modified_base (165)..(165): a, c, t, g, unknown or other
  misc_feature (165)..(165): n is a, c, g, or t
  modified_base (205)..(205): a, c, t, g, unknown or other
  misc_feature (205)..(205): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctccagacaccaccggagaaattgtgttgacncagtctccaggcaccctgtctttgtctaccgaggggaacnccgccaccctctcctggtacgggccagtcagtaatgttaagacgccactccttagcctcgtacagaactaaaaccgtcggaccacgcctaccgacgtcctcctactacttctagtcgtgccgtaccgacgacgggcccacgtcggcactccgacgtacgtacggttcgaacggttcgacgtacgggtcgggttacgtacgggtaaccgtacgtacctttacgacctacccttaccgaccctaacgtaccaaaccgtacggtacggtcggaccgtacgtacggtagtttacgtttacgttttcgacgttttcgggtttacctttttcgtacgtatacggtacgttaagtttacgggtacggttaaccgtttccggaccgttaacggtaccggtttaccggttcccggggaaaaccgggtcgggggttaaaccccgggtaaggggttaaaccgggtaaaacctaaaccggggttaaaaccggtaaccggtttacgggggtacgggtaccccgttaaacggcccggttaaccccggtttaaaggtttccccgttacgggtttaaccccctttacctttaaccccggggtttcccccgtttcccccggttaaacccg

SEQ ID NO: 42355 - DNA, 817 bp, Homo sapiens
  misc_feature: GYAE6OF01AQOFW.48.21.B10.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (611)..(611): a, c, t, g, unknown or other
  misc_feature (611)..(611): n is a, c, g, or t
tcagagtatacatacacgaccggtgctcgatttagtgtcgtcgcaaggaggaggaggggggaagagctgctcagttaggacccagacggaaccatggaaacccagcgcagcttctcttcctcctgctactctggctccagacaccaccgggtagaaattggtgttgacgcgtagtctccgaaggtcctacccgttggttcctttacgtccgtcccgaagggggaaacnccgacccacccttcnccgtagtacgggccaggtccaagtactgttaagactaccacttacgttacgacctgggtaaccaggaccaaaaactcggaccaacggccctccgacgtcctctctatcctgtacggtgaccgttccaccgacggaccacgtcggacactacccggaggtaccgtacggtaccgaggtacggtaccaacgggtttgggtaccgtgggggttaaaccacgggttaaccgtttccctacgttacccgaccgtaaaccctcttaaccgtaaccccgggaacggttacccggttaccgggaaccgaccggttacggtacgtttacgggtttaacgttttccggttcgttttaacgtttaccgttacggtttanaccgggtactcgggtaccgttacgggtaccctaacgttcgggtcccttaacggtcccggttaaccgttaacgggggcggaacggggtaacccgtaaggggtacgtaaccggaacgttaccgtaaaacgtaaccggttcggtacggaccgtgtaccccggaacttaccgtacggttctacggtttctaaccggtcctttaaccccgg

SEQ ID NO: 42356 - DNA, 505 bp, Homo sapiens
  misc_feature: GYAE6OF02HFWJC.48.21.B10.1.454.CMB.1.raw
  modified_base (205)..(205): a, c, t, g, unknown or other
  misc_feature (205)..(205): n is a, c, g, or t
  modified_base (416)..(416): a, c, t, g, unknown or other
  misc_feature (416)..(416): n is a, c, g, or t
tcagagtatacatacacgaccggtgctcgatttagtgtcgtcgcaagagaggagggggaagagctgctcagttaggacccagagggaaccatggaaaccccagcgcagcttctcttcctccctgctactctggctcccagacaccaccggagaaattgtgttgacgcagtctccaggcaccctgtctttgtctccaggggaaacncgccaccctctcctgtaggccagtcagaatgttaagagccactccttagcctggtaccagcaaaaacctggccagcctcccaggctcctcatctactggtgcgtccaccagggccactggcatcccagacaggttcagtggcagtgggtctgggacagacttcactctcaccatcaccagactggagcctgatgattttgcagtgttttcngtcagcagtatggaattcacctggacattcggccagggaccaaaggtgaatccaagactggtggctgcacatctgtcttcatctccgac

SEQ ID NO: 42357 - DNA, 517 bp, Homo sapiens
  misc_feature: GYAE6OF02HL68H.48.21.B10.1.454.CMB.1.raw
  modified_base (212)..(212): a, c, t, g, unknown or other
  misc_feature (212)..(212): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
tcagagtatacatacacgaccggtgctcgatttagtgtcgtcgcaagaggtagagggggaagagctgctcagtttaggaccccagagggaaccaatggtaaaccccagcgcagcttctcttcctcctgctactctcggctcccagacaccgaccggagaaattgtgtttgacgcagtcttccaggcaccctgtctttgtctccaggggaaancgccacctctccgtgtagggccagtcagaatgtaagagccatccttagcctggtaccagcaaaaacctgccagctccagctctcatctatggtncgtccaccagggccactggcgatcccgagacaggttccagtggacaagtgggtctgggaacaaggacttcactctcaccatcaccagactggancctgactgatttgcaagtgttttctgttcagcagtatagagttcacctcgactagttcggccagggaccaaggtcgaaatcaaacgactgtgctgcacatcngtcttcattctcctc

SEQ ID NO: 42358 - DNA, 742 bp, Homo sapiens
  misc_feature: GYAE6OF02I95FW.48.21.B10.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
tcagagtatacatacacgaccggtgctcgatttagtgtcgtcgcaagaggacgaagggggaagacgctggctcacgttaggacccagagggaaccatggaaaccccagcgcagcttctcttcctcctgcttactctggctcccagacaccaccggagaaacttgtcgttgaccgcagtctccaggcacctgtctttgctcaggggaaancgccaccgtctcctgtaggcagtcagaatgtaagngccactccttagcctggtaccagcaaaactggcagcctccacggctctcgatctatggtgcgtccacgaaggccaactcggcactcccgagacacggttacagtcgcgacgtggtactgggacagacttcacgtctacctacaacgtccaaccgagaacgtacggaacgtaccgtcgaaacgtcgtaaacgtttttcggacgttaaggtttcggtttttttaccgtacggttacgtaaacggttcccgttaaacgggttaagtttaacgggtaaccgttttaacccggtaaccccggttaccgggttaaaccgttaaccggtttacccgggtaacccgggtttaacgggggaacccgttaaaacgggttaacgggaaaacgttaaccgaaaccgggttaaacgtacgggttaacggtaccggttaacggaccgttaacccgttacgtaccggtttacgttaccggttaccggtaccgttacccgttccccggtaaccg

SEQ ID NO: 42359 - DNA, 684 bp, Homo sapiens
  misc_feature: GYAE6OF02FTIYJ.48.21.B10.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
tcagagtatacatacacgaccggtgctcgatttagtgtcgtcgcaaggaggagaggggggaagagctgctcagttaggacccagagggaaccatggaaaccccagcgcagcttctcttcctcctgctactctggctcccagacaccaccggagaaattgtgttgacgcagtctcaggcacctgtctttgctccgagggaancgccacctctcctgtacggccagtcagacttgttaagagccacttcttagcctggtaccagacaaaacctcggaccacgtccnccacggctaccgtcactctatcggttgccgtccacgtacgggccacgtcggacacgttcccaaggaccgtacggtttacaggtcggacgaggttcgggtcgtcgggaccacggtacttcgaacctccgtacaccacttacgaccgtaacgacgtcggacgtcctagtaactcggttaacttttcgacgttaggttttcgttttctcggttactacggtacttacggtagttcggttaacgttcgtaccgtaggtaccgttaggttaccggtcgggtaacgggtacccgaaagggttacgaaacttccggaaaccgtacggtacggttcggaccgttacgcccgtaaccgtacgttcgttacgtttaccgttaccgttacgttccccgtttcccgaacccg

SEQ ID NO: 42360 - DNA, 579 bp, Homo sapiens
  misc_feature: GYAE6OF02FP4M5.48.21.B10.1.454.CMB.1.raw
  modified_base (208)..(208): a, c, t, g, unknown or other
  misc_feature (208)..(208): n is a, c, g, or t
  modified_base (396)..(396): a, c, t, g, unknown or other
  misc_feature (396)..(396): n is a, c, g, or t
tcagagtatacatacacgaccggtgctcgatttagtgtcgtcgcaagagaggaggggggaagagctgctcagttaggacccagagggaaccatcggaaaccccagcgcagcttctcttcctcctgctactctggctcccagacaccaccggtagaaattgtgttgacgcagtctccaggcaccctgtctttgtcttccagggggaaancgccaccctctcctgtagggccagtcagaatgttaagagccactccttagcctggtaccagcaaaaacctggccagcctccaggctcctcatctatggtgcgtccacctagggccactggcactcccagacaggttcagtggcaggtgggtctgggacagacttcactctcacatcaccagactggancctgatgtattttgctagttgttttctggttcagtctagtatggtaacgttccaccgtcggtacgacgtttcgggaccgtaagggggaacctaaagggtcgaaaactcgaaaacgtacgtggtaggccttaggacctaccgtagttccgtagttacccttacgacttccgttaccccgtaccg

SEQ ID NO: 42361 - DNA, 548 bp, Homo sapiens
  misc_feature: GYAE6OF02HD4XU.48.21.B10.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (396)..(396): a, c, t, g, unknown or other
  misc_feature (396)..(396): n is a, c, g, or t
tcagagtatacatacacgaccggtgctcgatttagtgtcgtcgcaagagagaagggggaagagctgctcagttaggacccagagggaaccatggaaaccccagcgcagcttctcttcctcctgctactctggctcccagacaccaccggagaaattgtgttgacgcagtctccaggcaccctgtctttgctccgaggggaaancgccaccctctcctggtagggccagtcagaatgttaagngccactccttagccctggtaccagcaaaaacctggccagcctcccacggctcctcgactctatggtgcgtaccaccagggccactggccatccagacaggttcagtgcagtggtctgggacaggactcactctcaccatccaccagactggacnccgtgatgtatttgctagttgttttctgtacagtcagtatggtattcacgtcgactgttcggcagggacaggtagaatcgaaacgacgtaggtcggtctacgaccttaccgagttacttacgttccttacgtacgttcccttcccgtacccg

SEQ ID NO: 42362 - DNA, 732 bp, Homo sapiens
  misc_feature: GYAE6OF02IDHWV.48.21.B10.1.454.CMB.1.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
tcagagtatacatacacgaccggtgctcgatttagtgtcgtcgcaagagaggaggggggaaggaggctgctcagttaggacccagagggaaccatggaaaccccagcgcagcttctcttcctcctcgctactctcggctccagacaccaccggagaaattgtcttgacgctagtctccaggcacctgtctttgtctcgagggaancgccacctcgtcctgtacgggccagtcaaggaattcgttaagngccacttccttagctcggtaccagacctaaaacctgacctacgtcctccgacggctccgtcactctacgtggtcgccgtccaccgacggccacgtcggccagtcccaggactacggtctagngactacggtggtctgggaacagtaacgtttcacgtcnctaaccgtataccgaccaggtacgtacggtacgtacctagtacttacggtacttttacggactttaacgggtttccgtttttaggttaccgttacgtacggtaccgttaagttacgttaaacgggtaaccttttacgacccggttaacgtaaccgttaacgttacccggtaccgggtaacggggttaacccggaaagggttaacggtaaacgttaaccgaaaccggttaaccggttacggtacggttacgtacgggtaccaacccgttaacggttcgttaccggtttaaccgtttaccggtaacctttcgttaccccggtaaccg

SEQ ID NO: 42363 - DNA, 808 bp, Homo sapiens
  misc_feature: GYAE6OF02HE5FU.48.21.B10.1.454.CMB.1.raw
  modified_base (208)..(208): a, c, t, g, unknown or other
  misc_feature (208)..(208): n is a, c, g, or t
tcagagtatacatacacgaccggtgctcgatttagtgtcgtcgcaaggaggaggaggggggaagagctgctcagttaggacccagagggaaccatggaaaccccagcgcagcttctcttcctcctgctactctggctcccagacaccaccggagaaacttgtgttgacgcagtctccaggcaccctgtctttgctccgaggggaaacncgccaccctctcctggtacggccagtccagtaactgttaaacgagcctaacgttccgttagcctaggtaccagtaacaaaaaccgtcggacctaacgtccctccgacggtccttaccgtcactcctagtcggtcgaccgtccaccgacgggccacgtcggtccactacccgagtaaccgtacggttacgaggtcggcgtaaggtcgggtccgtagggaacctaacggtacccttacgaccgttctaccgaaccgtactaccctaaccgtacgtaccggttacggaccgtaccgttagacgttacgttagtttcgtacgttacgttttcgtttttcacggtttacctagtacccgtaaggtttacgtaggttaaaccgtttccgaacccgttacggtaaccgtttacggttaccgggtaaccgggtaaccggggttaaaccgtaaacggggtaaccggttaaaaccgtaccgggtaaaaccggttacggttaccggggttcggtaacccggtttaacggacccgttaaccggttaaccgttccggtttaacggtttaaccttcccggtttaacccttttccccggttacccccgttaaccg

SEQ ID NO: 42364 - DNA, 597 bp, Homo sapiens
  misc_feature: GYAE6OF02GONAS.48.21.B10.1.454.CMB.1.raw
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (414)..(414): a, c, t, g, unknown or other
  misc_feature (414)..(414): n is a, c, g, or t
tcagagtatacatacacgaccggtgctcgatttagtgtcgtcgcaagagaggtagggggggaagacgctgctcagttaggacccagagggaaccatggaaaccccagcgcacgcttctcttcctcctggctactctggctcccagacaccaccgganaaattgtgttgacgcagtctccaggcaccctgtctttgtctccaggggaancgccacctctcctgtagggccagtcagatgttaagacgccactccttagcctggtaccagcaaaacctggcctagtcctccgagtcctcctacatctatcggtcgccgtccacagggccacgtcggcactcccagactaggttccaggtcggcagtgggtctgggactagacttcactctacaccatacaccgagactacggtacnccctagactgtattttcgcttaagtttgttttctagttctagtctaagttataggtacgttcaccgtcgtactacgttccggaccgtagggtaccaagggttacgaactacgaacgtacgtggtacggtctacggactaccgtagttccgtagttacccttacgactttcccgtcccgtaccg

SEQ ID NO: 42365 - DNA, 784 bp, Homo sapiens
  misc_feature: GYAE6OF02JFPEG.48.21.B10.1.454.CMB.1.raw
  modified_base (208)..(208): a, c, t, g, unknown or other
  misc_feature (208)..(208): n is a, c, g, or t
tcagagtatacatacacgaccggtgctcgatttagtgtcgtcgcaagaggagagggggaagagctgctcagttaggacccagagggaaccatggaaaccccagcgacagacttctcttacctcctgctactctggctcccagacaccaccggagaattgtgttgacgtcagtctccagggcacccttgtctttgtctccaggggaaanccgaccaccctctcctgtagggccagtccagaatagttaagacgccactccttagcccgtaggtaccacgacaaaacctggaccacgcctccaggcctccgtcactactagtacggtcgacgttccaccgacggcccaacgtggccactcccagactagttcaggtggctacggtggtcctgggacacgtctactactctccaccatcgtacgagtacgtaggacgtcctagtactcgtacttttcgacttacgtttcgttttccgtaggttacgacgttacgtaacggttacgttacgggttaaccgttccgtaaccccgtttaaccgggtaaccgtttaccggtttaccgggtaacccccgggtaagggggttaaaccccggtaaaaggggttaaccgggttaaaaccgtttaacccggttaaaccgggttaaacccggtttacgggggttacccgggtaaccggtttaccccgggtaacccggttaaacccgttaacggttaccccggttttaacggttacccgttttaacccggtaaacccggttttccccgtttacccccggttaacccgg

SEQ ID NO: 42366 - DNA, 614 bp, Homo sapiens
  misc_feature: GYAE6OF02ISVXO.48.21.B10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (371)..(371): a, c, t, g, unknown or other
  misc_feature (371)..(371): n is a, c, g, or t
tcagagtatacatacacgaccggtgctcgattttagtgtcgtcgcaaggagagagggggaagagctgctcagttaggacccagagggaaccatggaaaccccagcgcagcttctcttcctcctgctactctggctccagacaccacggagaattgtgttgacgcagtctacagcacctgtcttgtctcgaggaancgccacctntcngtagcagtcagatgtaagacgccactctagctggtacagacaaaactgaccagtccgtaccaggcctccgtacactactagtcggtcgccgtccgaccgacgggcctacgtggaccactacccgaagaccgtacggttcacggtcggacgaggttcggttacgngggacacgtaacttcgactcgaccaacgactccaccgtagcgtacgacgctagattggtaactttcgacttagttttcgttttagtcgttactagtctacgttagaggtacttacgaccggttacgtactagttaccgggacgtagggtaaccgtaagggttaccaagttaccgaacgtacgttcggtagtcgtacgcctaacgtattccgtacgttacttccgtacgttaccgtacctaccg

SEQ ID NO: 42367 - DNA, 628 bp, Homo sapiens
  misc_feature: GYAE6OF02F9IKI.48.21.B10.1.454.CMB.1.raw
  modified_base (206)..(206): a, c, t, g, unknown or other
  misc_feature (206)..(206): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
tcagagtatacatacacgaccggtgctcgatttagtgtcgtcgcaagaggagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaaggggaaancgccacctctcctgtagggccagtcagaatgttaagacgccactccgttagccctggtaccagacaaaaacctgccagcctcccaggctccctcatctatggtcgccgtccaccgacgggcccacgtcggcagtcccagaccnggtcagtcgcnggtggtcgngggacagacttcgactctcacactcaccagactggancctgatgtatttgcttagtttcgttttctgtcacgtctaagtagtaggtacttacgtaccgtacggtactaacgtttccggaccggtaacgggtaacccgtaaagggttaacgggtaaacgtaacctaaacgggtacgttacgggtacgggtaactccggtaacctaaccgtacgttaccgttcggttacctttaccgtactttcccgtttaccccgaaccg

SEQ ID NO: 42368 - DNA, 574 bp, Homo sapiens
  misc_feature: GYAE6OF02G3ZSU.48.21.B10.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccatccttagcctggtaccagcaaaaacctggccagcctcccaggctcctcatctatggtgcgtccaccgagggccacgtggacactcccagacaggttcagtcggctagtggtcgtgggactagactcactctcgaccatccacacgactggacnctgatgtatttgctagtttgttttcgtgttcgagtctagttagtggtacgttacacgttcgatacgttcggacgacgggtaaccgtaggtaacggaatacgaacgtacgttaggtacggacttacggcctaaccgtacgttcgtacgttcttacctccgttcccgtacccgtaccg

SEQ ID NO: 42369 - DNA, 765 bp, Homo sapiens
  misc_feature: GYAE6OF02F1B28.48.21.B10.1.454.CMB.1.raw
  modified_base (153)..(153): a, c, t, g, unknown or other
  misc_feature (153)..(153): n is a, c, g, or t
  modified_base (209)..(209): a, c, t, g, unknown or other
  misc_feature (209)..(209): n is a, c, g, or t
  modified_base (252)..(252): a, c, t, g, unknown or other
  misc_feature (252)..(252): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagaccaccaccgganaaattgtgttgacgcagtctccgaggccaccctgttctttgtctccgaggggaacnccgccaccctctccgtgtacgggccaggtcagtatgtaagacnccactcttagcctaggaccagacaaaacctggaccacgcctcccgaggtcctacccgtcactctagtggtcgccgtaccaccgacgggcccacgtcggctactcccgagacgtacggttcgagtcggcaggtcggtcgtaggacagtacttcactctacgacctacgtaccaccgagtaccgtggacgtaccctagtacgttacggttatttcgtacgttaggttttacgtttttaccggtagttacggtacgttacggtaacggttacggttacgggtttaaccgttactaacccgggttaaccggtaccggtttacggttacccgggggtaaccgggtaacgggggtaaacccgtaaacggggttaacggtaaaaccgttaaccggtaaaccggtaaccgggttaccggttaacgggtaccgtttacgggaaccctaaccggtttacgtttacccggttacgttacccgggtttaaccctaccggtttacccccgttaccccggttacccg

SEQ ID NO: 42370 - DNA, 708 bp, Homo sapiens
  misc_feature: GYAE6OF02GCXCV.48.21.B10.1.454.CMB.1.raw
  modified_base (205)..(205): a, c, t, g, unknown or other
  misc_feature (205)..(205): n is a, c, g, or t
  modified_base (639)..(639): a, c, t, g, unknown or other
  misc_feature (639)..(639): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaancgccaccctctcctggtacggccagtcagaatgttaagacgacctactccttagcctacggtaccagaccaaaaccgtcggaccacgccctacccgacggtcctcctcactctagtcggtgccgtaccaccgacggccacgtcggacacctcccgaaggaccgtacggttacgaggtcggtcgtagggtcgggtcggtagggacgtaacgtacttccacgttacctaccgacctacgtccgtaacgccgtaccgggtacgttaacggaccggtaaacccgggtaaagtttacggttttacgttaaccgggtttttattaccgttaggttccgaagttccgtaacgttcggtaccgtacctacggtcgtcccttacgtacggtccgttaccggggacggtaacggacgtaagggtcgaactagtaacccgaacgnggtacggtccggctaccggaccgtactacggttccttacgttacctacgtccgttacccgtccgttacg

SEQ ID NO: 42371 - DNA, 722 bp, Homo sapiens
  misc_feature: GYAE6OF02G86DY.48.21.B10.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagtatacatacacgaccggtgctcgatttagtgtcgtcgcaagaggagaggggggaagagctgctcagttaggacccagagggaaccatggaaaccccagcgcagcttctcttcctcctgctactctggctcccagacaccaccggagaaattgtcgttgacgcagtctccaggcacctgtctttgctccgaggggaacncgccaccctctccgtggtacggccagtcagtaatagtaagngccactcttagcctggtaccagacaaaactggccagcctccagctcctcactctagtggtgccgtaccgacgacggccacgtcggaccacgtcccgagtacgtacggttccgaggttcggaccgtaggtcgggtacgtaggggaacctaaggttaccttcgaaccgttcctaaccgtacctaacgtcccgaaccgtacgaccgtacgggactacccgtaggtaactacggttaagttttacgccggtttaagggttttccgtttttacgttacggttacgtacgtacgtaagttacgttacggtaaccggttttccgaaccggttaccggtaaccgtacggtttccgggaaccggttaaccggggaacgtaaacggtacgggtaaacgtaaccggaacggttacggtacgggtcggtacgtacgactaaccgtagttacgttacgttccgttacgtacgttacccgttccccggtac

SEQ ID NO: 42372 - DNA, 696 bp, Homo sapiens
  misc_feature: GYAE6OF02IB653.48.21.B10.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
tcagagtatacatacacgaccggtgctcgatttagtgtcgtcgcaagagaggaggggggaagagctgctcagttaggacccagagggaaccatggaaaccccagcgcagcttctcttcctcctgctactctggctcccagaccacccaccggagaaattgtgttgacgcagtcctccaggctaccctgtctttgtctaccgaggggaancgccaccctntcctgtaggccagtcagaatgttaagagccactccttagcttcggtaccagaacaaaaaccctggaccacgacctaccaggcctccgtacactctagtggtacgaccgtaccaaccgacggacctactggactactaccgaagacgtaggtcaggtgactaggtcggtacgtaggacagacttacgactctacgacctagtaccaacgacgacttagggacgtccgtaaggtaagttgttaaagttttcggacttaaggttttcgtttttacttacggtactacggaattaacgttagtagggtaacgttaccggtaacgtaccggtaactacgttacgggaccgtaaagggggtacccttaaagggaacgtaaagttaaccgaaaccggtaacggttaggtaacggtacgtacgaaccgtaaccgtacttacgtaccgttaccgttacgtaccgttacccgttacccggtaacccg

SEQ ID NO: 42373 - DNA, 843 bp, Homo sapiens
  misc_feature: GYAE6OF02HF48O.48.21.B10.1.454.CMB.1.raw
  modified_base (221)..(221): a, c, t, g, unknown or other
  misc_feature (221)..(221): n is a, c, g, or t
  modified_base (512)..(512): a, c, t, g, unknown or other
  misc_feature (512)..(512): n is a, c, g, or t
tcagagtatacatacacgaccggtgctcgatttagtgtcgtcgcaaggagagagggggaagagctgctcagttaggaccagagggaaccataggaaccccagcgcagcttcgtcttcctctagctacgtctggctccagacgactacggagtaattcgtgttagacgctagtcctaccgaggcctaccgtgttacgtttagtcctaccggtaaggggaacnccgtccctaaccgttcgtaccggtacggtaccgggaccttaacgtacgaacgtaagttacgttaaggaccgtacctacgttacccgtagtacccggtaggtaaccacgtaaacgtaaacggcggtacctacgtacctaccgacgtacctccgtacacgttacacggtcggtacgacccgtaccgaccggacggtacccacgttacgcctaactacccggaagtccggttaacttcgaaggttccgctacggttggaccgaacgggtcaacggtttaccacgtacccgttanaccgaaccagtaacccgacggttatacggtacgtaccgtccgtaaagtacgtttacgggttaacttacggtacggtttacgttttaccgtttgaacgggttacgtaacgtagggttaaccgtttacgtacggtaacgttttacccggaaacggtttacccggtaggtttaccggtaacggtacgggtaaacggttacccggttaaaggtaaaacccggtaacgagtaacccggttaaggtccggttaaccgacggttccgaaaccgggtttactaaggtttaccccggttaacgttccgttacccgtacgtttccccggaaccttaacggg

SEQ ID NO: 42374 - DNA, 755 bp, Homo sapiens
  misc_feature: GYAE6OF02IWMOL.48.21.B10.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagagtatacatacacgaccggtgctcgatttagtgtcgtcgcaagagaggagggggggaagagctgctcagttaggacccagagggaaccatggaaaccccagcgcagcttctccttcctcctgctactctcggcctccagacaccgaccggagtaattgtgttacgacgcgagtctaccaggaccacccttgtctttgactaccgaaggggaacnccgccacccttcncgtcggtacggccaggtacaggtaactggttaaagcgacctacttaccgttacgccgttaggaccaacgaaccaaaaccgtcggacctacgccctaccgacggtcctacctactacgttcttagcgttcggacctaccgacgacggacctcgtacggacaccgttaccgaacgtacgtacggttacacgggtacgcgttacgggtcgggtaccgtgggaaccgtacgttaccgtacctacgtcccgtaactctaaccgtaccaacgaacggttaccgacggtacgtaccgtagttacgtagttcgttacgacttagtttcgttacgttcggaacgtacgacgttaggtagtagggtaccttacggccttaaggtacctacggtaccgggaccgtaaaggggtaaccgaggttaaaccgaacgtaaccgtaacgtacgttacgggtacgaacccggtgaaacccggttcgtaacgtttaccgttcggtaacctttccggttacccttacccggttcccgtaaccg

SEQ ID NO: 42375 - DNA, 716 bp, Homo sapiens
  misc_feature: GYAE6OF02JB9ZB.48.21.B10.1.454.CMB.1.raw
  modified_base (204)..(204): a, c, t, g, unknown or other
  misc_feature (204)..(204): n is a, c, g, or t
  modified_base (710)..(710): a, c, t, g, unknown or other
  misc_feature (710)..(710): n is a, c, g, or t
tcagagtatacatacacgaccggtgctcgatttagtgtcgtcgcaagagagagaggggaagagctgctcagttaggacccagagggaaccatggaaaccccagcgcagcttctcttcctcctgctactctggctccagacaccaccggagaattgtgttgacgcagtctaccaggcacccgtgtcttgtcctccgaggggaacnccgccacccttctaccgtggtacggccagtaccgaagtaacttgttaaggacgtaccctaccgttaccttacggtcccgtacggttaaccacggtaaccctaaaaaccgtcggaccctacggtacccctcccgtaacggtcccctacctctactaccgtagtcggtacgccgacccgaccgtacggccctacgtcgactacctaccccgagtaacgttacgttcgaaggtcggtacgtagggttcgggtcgacgggtaactacggtaccttcggacttccgtacctactacgtcaacgcctacgtacccgtgtacgtagttcgttaacgtacgtttacttttaaaccgtattttacgtacttgtacgtcgtagtacgttagtactaacggtacgtaccgtaccgttacgtcggaaccggacgtaacggtaggtccgtaactaacggacttacggtggtacgtacttacggaccgtactcgttacttcgttcaaccttcgttacccnccgttc

SEQ ID NO: 42376 - DNA, 552 bp, Homo sapiens
  misc_feature: GYAE6OF01CGX75.14.41.D08.1.454.CMB.1.raw
  modified_base (372)..(372): a, c, t, g, unknown or other
  misc_feature (372)..(372): n is a, c, g, or t
  modified_base (543)..(543): a, c, t, g, unknown or other
  misc_feature (543)..(543): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtgttactactggagctggatccgccagcacccagggaaggctggagtggattggctacatctatcacagtggagcacccactacaacccgtccctcaatagtcgacaaaccatatcagttgacacgtctaaagaaccagttcctccctgaagctgagctctgtgactgccgcggacacggccgtgtatttacgngtgcgaggtcgattgtgatggtaactaactgcttcttactcctttgacctaggtgggccgggaacctcgggtcaccgtctcttcacgcctccaccacggcccactccggtccttccccgtcggtcccacccctccctccctaacgacgcacccgtcgtagggggccaccgnggtcccggg

SEQ ID NO: 42377 - DNA, 553 bp, Homo sapiens
  misc_feature: GYAE6OF01DOKC3.14.41.D08.1.454.CMB.1.raw
  modified_base (465)..(465): a, c, t, g, unknown or other
  misc_feature (465)..(465): n is a, c, g, or t
  modified_base (543)..(543): a, c, t, g, unknown or other
  misc_feature (543)..(543): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaggcctggagtggattggctacatctatcacagtgggagcacccactaccaacccgtccctcaatagtcgacaaaccatatcagttgacacgtctaagaacctagttctccctagaacgctgagctctgtgactggccgcggaacacggccgtgtattacgtgtgcgaggtcgattgtagataggtaacactgtcttcttactcctttcgaccgtaggtcggggccgggaccctggtcaccgtctcttcncgcctccaccgacggccctacgtccgtccttccccgtcggccaccctcctcccgaacgtcgcctacctcgtggggccncgcggcccgg

SEQ ID NO: 42378 - DNA, 549 bp, Homo sapiens
  misc_feature: GYAE6OF01B0EOR.14.41.D08.1.454.CMB.1.raw
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcaccagggaaggcctggagtggattggctacatctatcacagtgggagcacccactacaacccgtccctcaatagtcgacaaaaccatatcagttgacacgtctaagaccagttctccctgaagctgagctctgtgactgtcgcggacacggccgtgtacttactgtgcgaggtcgattgtgatggtaacaactgctttcttactcctttgacctaggtcggggccgggacctggtcaccgtctcttcacgtcctccaccgacggcccacgtccggtcccttccccgtcggccctacccctccctcccaacgcgcctaccgtcgtcggggcacgcggcccggg

SEQ ID NO: 42379 - DNA, 773 bp, Homo sapiens
  misc_feature: GYAE6OF01CY004.14.41.D08.1.454.CMB.1.raw
  modified_base (261)..(261): a, c, t, g, unknown or other
  misc_feature (261)..(261): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctcatcatcagtggtggttactactggagctggatccgccagccacccgaggggaacgggcctggagtggattggctacatctatcacgagtgggacncaaccccactaccaaccccgtccctacaatacgtccgaacaaaccatactcagttcgactacgtactaagacctagttcctccctagaacgcctaggacgtaccttcgttacggtcgaaccgttcggaccccgggtacgggaaccgaaccggggtcccggttaggtttaaacgtttaaccggtggttacggcccgggttaaggggttaccggtaagtttggtaggtaacgttacgggttaaaaccgtaacgtttacggttacccttttaccttttaaccctttacccgtttttacggaacccgttacggggttaccggggggtaccccggggtaacccgttcgggtaccgtacccggtttccgttcccgtttccgtaccgtcccgttacccacccggtaccgggtacccctacggttcccggttccccgttcccccgtccggtcccctaccccgttaccctacccgaacgaccgtaccctacccgtccggcggggaccacgccggtcccggg

SEQ ID NO: 42380 - DNA, 929 bp, Homo sapiens
  misc_feature: GYAE6OF01AQ8MX.14.41.D08.1.454.CMB.1.raw
  modified_base (148)..(148): a, c, t, g, unknown or other
  misc_feature (148)..(148): n is a, c, g, or t
  modified_base (277)..(277): a, c, t, g, unknown or other
  misc_feature (277)..(277): n is a, c, g, or t
  modified_base (513)..(513): a, c, t, g, unknown or other
  misc_feature (513)..(513): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggacgtggtgtaagccgttccacgagaccctcgtcccncacctgtcactgtctctcggtggctaccatcatcgtagtcgggtggttactactgggagctggtactccggccaacgcaacccggtaggggaaagggccttgggagtgggtagttcgacgtacctaatntaaccggtcaaacgaggtcggggacgcccgtaaccctacgtaaacccgaaaccgtttcccccgacgtaaaattacgggtacccgaaacctaaaacccaatttacctaacgttaccggtagtaacccgaacgggtttcctaaaacgtaaaacccgtcgtttacctccccttaaggaggtaccctagtaccggacgtttccagggtttagaactccggtaccgggaccgggtaaaccnccggggtccccggttaatttaaacgttaaccggttggcggtaacggtaccggttacggttaacgtcgttagtacggttacggttaaacaacggttactacgggttttacccttacgttttacccgtttagaacccggtttacggggttacccggggggtacccgggttaacccgttccggggttacccttaaaccccggggttacccttcgggttacccgttaacccggtaaccccttcccggggtaacccggttaacccgaccgggggtttacccctttcggggttaccccccgtttaccccggttcccggacccccgtttaaccccgttaccccaaccccgtttaaaccgggacgttaaaccccgtccccgaaccccgggtttgggggcccccttaaccggtccgggacccccg

SEQ ID NO: 42381 - DNA, 800 bp, Homo sapiens
  misc_feature: GYAE6OF01DRADD.14.41.D08.1.454.CMB.1.raw
  modified_base (193)..(193): a, c, t, g, unknown or other
  misc_feature (193)..(193): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtcccctcacctgcactgtctctggtgctccatcatcagtggtggttactactgganctggactccgccagccacccgagggagggcctggagtggattggctacatctatcacgaggtgggacgaccaccccgaactaaccaacccccgtccctacaaacgtacgtaccgaaccaaaaccctatactacaagtttcgaacctacgttactaaacggaaccctacgtttcctacccgtaggaacgtcctggacgtccttcgttggtaccgtaccgtccggacccggccgggtaaaccgtacccggggtacccgttggttttaaacctttaccggtgggttacggtaccgggtacggggtaccggtaagtttgggtacggtaggttaacggtaaaccgtaacgttcgttacttttaccgttacctttccgtttacgtacccggtacgggtccgggggtaccccgggtaacccgtcggttacccgtaccggtttccttaccgttcccgtaccgtcccctacccgaacccggtaccggtaccccttaccgttcccggttccccgttacccccggtccggtacccctacccccgttaccccgttacccgaaaccgtaccggaccctacccgtacgggtaccggggccctaaccgccgggtaccccggg

SEQ ID NO: 42382 - DNA, 761 bp, Homo sapiens
  misc_feature: GYAE6OF01BH6WI.14.41.D08.1.454.CMB.1.raw
  modified_base (236)..(236): a, c, t, g, unknown or other
  misc_feature (236)..(236): n is a, c, g, or t
  modified_base (462)..(462): a, c, t, g, unknown or other
  misc_feature (462)..(462): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccagggactggtgaagccttcacagaccctgtccctcacctgcactgtctctggtggctccatcatcagtggtggttactactggagctggatccgcagcaccgagggaggctggagtggattggctanatctatcacgaggtggacgccaacccactaaccaaccccgttccctacaaagttacgtaccgaaccaaaacccgtataactacgtaggttacgaacctacggttaccttaaaacggaaccctagtttccctacccgtagaaacgtcctaggacgtccttacgttggtacgtaactccggacccgggtaccgggaaacctaccgggtccgttagttaactttaccgnggtacgcggtaggtacgtagttggtagtagttacggtaaacctaacgtcgttactttacctttaccttaccgtttacgaccgtacgggttaccggggtacccgggtaacccgttcggtaccgtacccgttccgttaccgttaccgtaccgtacccgttacccgaaccgtaccgggtacccgtacgttcccgggttccccgttacccccgtcgggtacccctaccccgtcccgtaacccgtaaccgaaccgtaccgtaccccgtacggtaccgggggacctaccggaccgggtccccggg

SEQ ID NO: 42383 - DNA, 924 bp, Homo sapiens
  misc_feature: GYAE6OF01BJU5A.14.41.D08.1.454.CMB.1.raw
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtcccctcacctgcactgtctcgtggtggctcatcatcgagtggtggttactacgtggagcgtggactccgaccagccaccgaggggacggccgtgggagtggtagtcggactactagttactataccgacggtaggtcggggacgtacccaacccgtaaccctaaccgtaacccccgtcccgtaactaaacgttaaccgtaccgaaaaccctaaaacctaacttaacgtaaccgtacggtttaaccgaaaccgtaaccggttaacctaaaacggttaaaccctaaccggttttacccctaacccgttaggtaaacctaccgttacggaccgttccgttacgttacggtacgtaccggttaccggaccccggggttaccggaacccgggtaaccggtacccggtttaaggtttacgttttaacccggtagggtacggtaccgggttaaccgggttacgttaggttttagggtaacggttaaagggttaaccggtaaacccgttaacggtttacttacgttttaaccccgtttacccttacggtttaccgggacccgttaacggggtccgggggtaccccgggtaaccggtttccggtacccggtaccccgttcgttacccgttaccgtaccgtaccccttacgtaacccggaacccgtcccggtacgtttccccggttacccccgtcccccggtaccggtaccccttaccccgtcccgaaccccgtaaaggtccccgtacccgtacccggtacggggtacccggactcccgggccggtacccccgggg

SEQ ID NO: 42384 - DNA, 743 bp, Homo sapiens
  misc_feature: GYAE6OF01AIURS.14.41.D08.1.454.CMB.1.raw
  modified_base (282)..(282): a, c, t, g, unknown or other
  misc_feature (282)..(282): n is a, c, g, or t
  modified_base (709)..(709): a, c, t, g, unknown or other
  misc_feature (709)..(709): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctcgtggtggctccatcatcagtggtgttactacgtggagctgggactccggccagccgaacccgaggggaacgggccgtagggaggtggtagttggacctactatctatacacgtaggtacgggacnccgacccctaactacccgtaacccgtccctacgtaacgtacgtacgaaacctaaaacccagtaactctaacgtttcgaaccgtaccgttacctaaaaccgacccttaacgttccgtaccccgttaaggaaccgtcgttacgacgtccttcgtcggtacgtcgtcgaccggaccggtaacgaacggtcccgttagtaaccgttcggtacgtgtacgggtaacggtgttaacgtgtacgtacgttacgtaaactacgtccgtactttaccttaccttacgtttcggacccggttacgggtccgggggtacccgggtaacgtccggttaccgtcgtcctcgtacgcgtcccgtaccgaaccgtaccgcccgtacggttcccgtaaccccgttccccgtcggtacccctcccgttaccacccgacgtaccnccgtaccgcggttacgggacctcgacgggtcccg

SEQ ID NO: 42385 - DNA, 921 bp, Homo sapiens
  misc_feature: GYAE6OF01EKRBT.14.41.D08.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtagaagccttcacacgaccctgtccctnacctgcactgtctctggtgctcatcatcgagtggtgttactacgtggancgtggactccggccaacggccaacccggaagggggaacgggtccctaggggtaacgtgggtactttcgggaccttaactattctaatccgaacgtaggtacggggaacaccaacccctaacgaacccgtaacccccggtcctagaaacgttacgtaccgaaaccaaaaccgtatactacgacggttacactacggttacaaacggaccctagttccacctagaacgtctagacgcttcgtagtcgacgtcgacggtacggaaccgtccggtactttaggtaacttaggcggtacggtacggtacggtcgtaagtttcggtaacgtaaggttaacggtaaacttaaccgtacgtttacccgttttaaccgtttaaccgtttacccgtttacggtaaacccgggtacgggggttacccgggggtaaccccggggtttaaacccgttcgggttacccgttaaaccccggtttcgttaccccgtttaaccggtaacccggttacccccgttaaccccggtaaacccgggtaaccccggggttacccccgttaacgggtttacccccggttttaccccgtttacccccccggtttaacgggtaaacccccctttaacccccggtttacccccgttaaacccgaaacccgggtaacccgttaccccgttaaaccccggttacccggggtaaccgggggtaccctaaaacccggggtcccggttcccccggggg

SEQ ID NO: 42386 - DNA, 544 bp, Homo sapiens
  misc_feature: GYAE6OF02FOLJC.14.41.D08.1.454.CMB.1.raw
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagacccctgtccctcacctgcactgtctctggtggctccatcatcagtggtggttactactggagctggatccgccagcacccagggaagggcctggagtggattggctacatctatcacagtgggancaccactacaacccgtcctcaatagtcgacaaaccntatcagttgacacgtctaaagaaccagttctccctgaacgctgagctctgtgactgccgcgacacggctgtattactgtgcgaggtcgattgtgatggtaacaactgtcttcttacttcctttcgaccgtagtcggggccgggtacctcggtcgtaccgtctcttcacgcctccaccacggcccacgtccgtccttccccgtggccaccctcctccaacgacgccaccgtccgtcggggcacgaggcccgg

SEQ ID NO: 42387 - DNA, 542 bp, Homo sapiens
  misc_feature: GYAE6OF02F21FI.14.41.D08.1.454.CMB.1.raw
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
tcagcgtctagtaccacgaccggtgctcgatttagtcacgcgagaaagggaaagggtccgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttcncctgaagctgagctctgtgactgccgngacacggccgtgtattactgtgcgaggtcgattgtgatggtaacaactgcttcttactcctttgaccagtggggccgggacctggtcaccgtctcttcacgcctccaccaacggcccatccggtccttcccccgtggcccaccctcctcccaacgacgccacctcgtcgggggccacgacggcggtcccgg

SEQ ID NO: 42388 - DNA, 564 bp, Homo sapiens
  misc_feature: GYAE6OF02GH48T.14.41.D08.1.454.CMB.1.raw
  modified_base (254)..(254): a, c, t, g, unknown or other
  misc_feature (254)..(254): n is a, c, g, or t
  modified_base (345)..(345): a, c, t, g, unknown or other
  misc_feature (345)..(345): n is a, c, g, or t
  modified_base (557)..(557): a, c, t, g, unknown or other
  misc_feature (557)..(557): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaggcctggagtggattggctacatctatcacagtgggancacccactacaacccgtccctacaatagtcgacaaaaccatatcagttgacacgtctaaagaccagttctccctgaacgctgagctctgtnactgccgcggacacggccgtgtattactgtgcgaggtcgattgtgatggtaacaactgtcttaccttacttcctttgaccgtaggtcggggaccggggtacccgtgggtccaccgttctcttacgacgcctccaaccgaacggcccacgtccgtccttccccgtcggccctaccctccctccaacgcgaccaccgtccgtcggggactacgngtcccgg

SEQ ID NO: 42389 - DNA, 621 bp, Homo sapiens
  misc_feature: GYAE6OF02JIMJ6.14.41.D08.1.454.CMB.1.raw
  modified_base (352)..(352): a, c, t, g, unknown or other
  misc_feature (352)..(352): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaggcctggagtggattgggctacatctatcacagtgggagcaccactacaacccgtcctcaatagtcgacaaaccatatcagttgacacgtctaaagaccagttcctccctagaagctgacgctctgtgactgccgngacgacggccgtgtattactgtcgcgaggtcgattgtgagtggtaacaactgtcttcttacttcctttgacccgtaggtcgggggcccggggtaaacccgtcgggtcctaccggttccttccgttcgacggtcccttacccgaacccgtaacggggcccctacgtaccggttcccttcccccgtcggtccctaccccgttaccctacccgtaaacgtaccggaccctacccggttccgtcggggggaccctaccggaccggtacccggg

SEQ ID NO: 42390 - DNA, 677 bp, Homo sapiens
  misc_feature: GYAE6OF02I15XB.14.41.D08.1.454.CMB.1.raw
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcaccgagggaaggcctggagtggattggctacatctatcacagtgggagcacccataccaacccgtcctanaatacgtcgacaaaacctntatcagttcgaactacgtactaaacgaacctagttcctaccctagaaacgtccttaggaacgtcctacgtggtacgacttcggaccggtcggaacaccgggccgttaggtaactttacgtggtaggccggtaggtacgtatttcggtagaagttaggtaaacctaagtcggtacctttcgtttaccttccgtttcgaacccgtaggggttaccggggaccccggggtaaacctcgggtacctaccggttccttccgtaccgacgtaccccgttccaaaccggtaacggcccctaagtcccggtacccttccccgtccggcctacccctcctaacccgaagaccgtcccaccgtcggtcggggacccacgaccggtcccggg

SEQ ID NO: 42391 - DNA, 660 bp, Homo sapiens
  misc_feature: GYAE6OF02JQRRR.14.41.D08.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (416)..(416): a, c, t, g, unknown or other
  misc_feature (416)..(416): n is a, c, g, or t
  modified_base (646)..(646): a, c, t, g, unknown or other
  misc_feature (646)..(646): n is a, c, g, or t
tcagcgtctagtaccacgaccggtgctcgatttagtcacgcgagaaagggaaagggtacgtgtgaaggcgttcaccagtcctgtcccaggtgcagctgcaggagtcgggcccaggactggtgaagccttcacagaccctgtccctcacctgcactgtctctggtgctccatcatcagtggtggttactactgganctggatccgcagcaccagggaggcctgggatggattggctacgatctatcacgngtgggagcaccgactaccaaccgtcccctanaactacgtcgaactaaaaccatattccagtttacgacacgtctaaaacgaccaagttcctacccctaggtaaactcgtacgaagtctacgtgtacgactcgccgtaccgggcacgggttccgtagttaatttacgngtcggacgtacggtcgagtttcgtagtacgtaggtaaacacttggtcctttacgtacgttacctttggtaacccgtaagggttccggggaccggggttaaacccctgggtttccaaccggttctaccgtttcgaacgtccttacgacccgtaaggccctagtacccggttctccccgttggccctaacctcccgtaacgaacacggacctacccgttcgccgggggtacnccgtaggtccccgg

SEQ ID NO: 42392 - DNA, 800 bp, Homo sapiens
  misc_feature: GYAE6OF02HCG7B.14.41.D08.1.454.CMB.1.raw
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagccacccgagggaaggcctggagtggattggctacatctatcacagtgggacgcacccactaccaaccccgtcctacaatagtcgaacaaacctatactcagttgaacctacgtactaaacgaacctagttcctcccgtagaacgtccttaggacgtccttacgtgtacgtacctcggacccggacggaaccgtaccgggtcccggttagtttaacgtttaccgtcggtcggaccgggttaacggggtacggttaacgtttgggttacggttaaagttacggggttaaaacctaaacgttcggttaccttttacccgttttaacccgttcccgttttacggtaacccgtacgggggttacccggggggtaaccccgggggttaaaccccgttcgggttacccgtaacccggtttccttcccgtttaccgtacccggtaccccgtaccccgtaaccggtaacccgggtacccctaccggttcccggttcccctttcccccgtacggtacccctacccccgtacccgtacccgtaaccggtaccgtacccgtacccggtccgggtaccgggggaccctaccggaccggtccccgggg

SEQ ID NO: 42393 - DNA, 686 bp, Homo sapiens
  misc_feature: GYAE6OF02JLD95.14.41.D08.1.454.CMB.1.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (673)..(673): a, c, t, g, unknown or other
  misc_feature (673)..(673): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtgctccatcatcagtggtggttactacgtggagcgtggactccgccagccaccgagggacggcctggagtggattcggctacatctatcacgaggtgggacnccaccactaccgaaccccgtcctanaaatacgtaccgaaacaaacctatactcgagttacgaacctacgtactaaacgaacctgttccctacccgtagaacgtcgtaggacgtccttcgtacgttacgactccgggccggaccgggtaaccgaccgggttaccgttaggttacgtttaacgtcggtacggacggtacgggttacgttagttgtaggtaacgtacggtaactacgttgttacctttacttacctttccgttacggaccgtacggggtccggggacccgggtaaccgtcggttccgtaccgtcttccgtcgccgtccctacgaaccgtacggcccgtacgtccgttcccttcccgtacggccctaccgtccaccgaacgctaccgccgtccggtacgggaccncggacgtcccggg

SEQ ID NO: 42394 - DNA, 766 bp, Homo sapiens
  misc_feature: GYAE6OF02GEW5G.14.41.D08.1.454.CMB.1.raw
  modified_base (362)..(362): a, c, t, g, unknown or other
  misc_feature (362)..(362): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccgagggagggcctggagtggattggctacatctatcacaggtgggagccacccactacaaccccgtccctcaatacgtcgaacaaaccatactcagttgacacgtctaagaaccagttcctccctagaacgctgagctctgtcgactgccgnggacaccggcgtagtacttacgtgtcgacgtaggtcgtagttgtgaagttagggtaaacctaaacgtgtacctttaccttacctttacccgttttacggaacccgttagggttcccggggggtaaccccgggggtaaaccccgttcggggttaacccgtacccggtttacccgtttcccgttttacccgtaaccggtcccccgtttaccccgaaaccccggttaaaccggggtacccccctaacgggttccccgggtttacccccgtttacccccccggttccgggtacccccgtaaccccccgtttaccccgttaacccccgaaacggtacccggtaccccgtaccccggttacccgggtcccgggggggaaccctacccggtaaccgggtaccccccggggg

SEQ ID NO: 42395 - DNA, 764 bp, Homo sapiens
  misc_feature: GYAE6OF02JU9DX.14.41.D08.1.454.CMB.1.raw
  modified_base (287)..(287): a, c, t, g, unknown or other
  misc_feature (287)..(287): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtgctccatcatcagtggtggttactactggagctggactccgcagcacccgagggaacgggcctgggacgtggattcggctacatctaatcacgaggtggagcaccctactacaacccgtcccctanaactagtccgacaaaaccatactactagttcgaacacggtctaacgaaacctacgttctaccctggaaacgccttagaacgcttacctggtacgacttcggtaccggaccggtaaccgacggacccgtttagtaacttaccgtggtacgcgtacggtcgtaattccggtagtagtaggtaacctaacgtggttacctttacttacttcccgtttcgaacgttacgggtcgggggtaacccggacccttaggggttaccctaccgggtactttaccgttacgtaaccggtacccgtttaccccgaaacccggtaacggggtaccccaagggtttccccggttaccgtttccccccgtttaaggggcccccttaaccccccgttcccgttaaccccgtaaacggtcccgtaaccccccgttaccggttacccggggttacggggtaccccggttaaccccaccgggggtaccccccggg

SEQ ID NO: 42396 - DNA, 644 bp, Homo sapiens
  misc_feature: GYAE6OF02IIF5Q.14.41.D08.1.454.CMB.1.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
  modified_base (603)..(603): a, c, t, g, unknown or other
  misc_feature (603)..(603): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacacgaccctgtccctcacctgcactgtctctggtgctccatcatcagtggtcgttactacgtggagctggactccgcagccaccgagggacggcctggagtggattcggctacatctancagagtgggacncacccataccaccgtcccanatgtacaacaaacctatactcgagtttacgaccacgttactaaacgacctacgtttcctacccgtagaacgtccttaggtacgcttctgtcgacgtcgcccgacggaaccgtcggtccttagttacttcgnggtcgcggtagtacgttattggngtagtacggtactacgtgtccttttaccgtacttccttacggacgtcgggtaccgggggtacccggactcgggtacccaccggttctttaccgcaccggccctacccgaaggtaccgcccttagtcccggttccctccccgtcgccctaccccttccgtaaccgagcccnccgtacccgtttggggaccggtccacggtacggtccccggg

SEQ ID NO: 42397 - DNA, 817 bp, Homo sapiens
  misc_feature: GYAE6OF02IZUU7.14.41.D08.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactgggtgaagccttcacagaccctgtccctcacctgcactgtctctggtgctccatcatcagtggtcggttactagtggtancgtggacgtccgccgagccgacccgagggaacgggtcctggtacgtggagttggctacgatctatcanaggtggacncctaaccgactaccgaccctcctaacaacgtacggtacaactaaaacccgtattaacgttaccgtaacggttacgaaccgtaaccggttaaaccggtaaacctaaaacccgttacgtttaccctaacccggtacggtaaactccggtacggtaacggtccttacggtttcgtacgtaacccggttcgcccgggtaacgggtaaccgtaccgggtccttaacggtttacgttaaccgttggtccgggtaacgtacggttaccggtagtttagggtacgtaacggttacggtaaaccttacgtacggttactttaccgttaaccgtttccgtttaacgtaccgggttaccgggtaccgggggtacccgggttaacccggtcggtacctcccggttacgttcctacggtaccctccgtacccgttaacccggaccggtaaccgtccgttacccgttcccgttacccggtccgtacccgtaccccgtcctaaccggtacgtaccggtacccttaaccggtcggacgggtcccgacggaccgtacccggg

SEQ ID NO: 42398 - DNA, 760 bp, Homo sapiens
  misc_feature: GYAE6OF02G2ORO.14.41.D08.1.454.CMB.1.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcacgtgtctctggtggacctcatcagtcagtggttaggttacctacgtggatcgtggactccgccagcaccgagggacggcctggagtggatggctacgntctatcagcggtgggaacnccgtaccctacgtaacccgtaccccggttccctacgtaacgttacgtaccgaaacccaaaacctcttaacttccgaagttcgtaaaccgtccgttaacgtaaaacgtaacccgtacgtttcccgtaccccgttagaaacggtcctcgggaactccgtttgttcggtacgtaccgtcgggacccgtccggtacggaccgggtcccggtttagttaccttaggttcggcgtaacggtacgggttacgtagtttcggtagtaggtacggtaacctacgttcgttacttaccgtttacttccgttacgacggttcgggtacgggggtaccgggtccggtcggtaccgtcgttaccgttcgtaccgtaccggtacctccgaaccggtaccggtaccgtaccgttaccgttccccgtttcccggtccgtaccctccccgttacctacccggaacgtccgtcctaccggttccggtacggggctaccggacggtcccggg

SEQ ID NO: 42399 - DNA, 705 bp, Homo sapiens
  misc_feature: GYAE6OF02GK0NF.14.41.D08.1.454.CMB.1.raw
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (691)..(691): a, c, t, g, unknown or other
  misc_feature (691)..(691): n is a, c, g, or t
tcagcgtctagtaccacgaccggtgctcgatttagtcacgcgagaaagggaaagggtctgtgaaggcttcaccagtcctgtcccaggtgcagctgcaggagtcgggcccaggacgttggtgaagccttacacagaccctgtccctcacctgcactgtctctggtgctccatcatcaggtggtggttactacgtggagcgtggctccgccgagccacccgagggacggccgtggacgtggtagttggctanacgtctatcacgtggtaggacncctacccgactaccaacccgttccctanaacgttacgtacgacctaaaccnttacacgtagtaccgaactacgtacgtaacgaacctcgttccgttaccgtgtaacgtgtcgtaagtccttacgtagtccgaagtcccggacggcgtaacggccggtccgttagtttaccgttggtacgtcgggccggtagggttacctgtttggacgttaggtacgaaacttcgtcgttctttacccttgtttccgtaagccggttaacgggccggggtaaacccggtccgttgaacccggtttcctagttcccgtttcgacccgtcccaaccggttaaccggacccggtcctaacggtcccgttacccgtccccgtacggcctaacccgtcgtaacgaccgtaccgtcccaggtttccggacgaccncggtacggtcccgg

SEQ ID NO: 42400 - DNA, 461 bp, Homo sapiens
  misc_feature: GYAE6OF01CKTUN.23.72.G06.1.454.CMB.1.raw
  modified_base (454)..(461): a, c, t, g, unknown or other
  misc_feature (454)..(461): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgattattttgactggttattctcccggaggctactactacatggacgtctggggcaaagggaccacggtcaccgtctcctcagcctcaccaagggcccatcgtctcccctggcaccctcctccaagacgcacctctcggggcacgagcggccctgggcctgcctggtcaaggactacttccatactcgcgtctgagcgggctggcaaggcgcatagnnnnnnnn

SEQ ID NO: 42401 - DNA, 523 bp, Homo sapiens
  misc_feature: GYAE6OF01CFZ39.23.72.G06.1.454.CMB.1.raw
  modified_base (226)..(226): a, c, t, g, unknown or other
  misc_feature (226)..(226): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaattggtatcagcagaaaccagggaaacgccctaagctcctgatctatgctgcatctagtttcaaagtgggtacccatcgaagttcaagtggcagtggatcgtgggactagtatttcacgtctactaccatcagtcagtctgcaacctgtaagtatttgactaacttactactagtacaactagtacgttacacgtaccccgtagtacctttacggaccgtagggtaccaacggtcgtacggagtacgtacgaaacgtagacgtggcgtacgg

SEQ ID NO: 42402 - DNA, 720 bp, Homo sapiens
  misc_feature: GYAE6OF01EKKIF.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaattggtatcagcagaaaccagggaaacgccctaagctcctgatctatgctgcatccagtttcgacgtaaaggtcggggtacccaagtacgtaaagggtttccaaggttcgggaccgtaaggttagggtaacgttcggtaggggtaactaaggtacttttaccgtaaccttccttaccctaaccctaacttaccgaacggtaccgtaacggttcctacggtaccctaaacccgttaggtaaacgttaacgttttacggtaaccttaaacctttaaccgttaaccgttacgttaaccgtaaaccgtaacggttaaccgtttaaccgtaacccggtttaacccccgttaaaccgttaaccggtttttaccgggacccggtaaacgggggtaacccgtaaacgggtaccggttaagggtaaacggtaaccgttaaaccgtaaaacccggtaacgttagggtacgggtaacccgg

SEQ ID NO: 42403 - DNA, 512 bp, Homo sapiens
  misc_feature: GYAE6OF01D1FQ2.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtacccagtacaaaggttcgaagtggacaggtggaatcgtgggactagtagtttcacttctacaccatcagcagtctgcaactgaagtatttgctaacttactacttgtacaactagattaacacgtacccgtactactttacggcctagggaccaacgcgtagactaacgtacaaacgactgtgtacg

SEQ ID NO: 42404 - DNA, 514 bp, Homo sapiens
  misc_feature: GYAE6OF01AKES3.23.72.G06.1.454.CMB.1.raw
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaanccctaaagctcctgatctatgctgcatcctagttgacaaagtgggtcccatcgaagttcagtgngagtggatcgtgggacagtattcactctcactatcagcagtctcgcaaccgtgtaagtagtttcgactaacttactactgtacaatagattaccacgtaccccgtactacgtttcggaccgtagggacctaagtccgtaggacgtaacgtacaaacggtacttgtggtaccg

SEQ ID NO: 42405 - DNA, 456 bp, Homo sapiens
  misc_feature: GYAE6OF01CT249.23.72.G06.1.454.CMB.1.raw
  modified_base (451)..(456): a, c, t, g, unknown or other
  misc_feature (451)..(456): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttattctcccggaggctactactacatggacgtctggggcaaagggaccacggtcaccgtctcctcagcctccaccaagggcccatcggtctccccctggcaccctcctccaagagcacctctggggcacagcggccctgggctgcctggtcaggactacttccatactcgcgtctgagcgggctggcaaggcgcatagnnnnnn

SEQ ID NO: 42406 - DNA, 517 bp, Homo sapiens
  misc_feature: GYAE6OF01E0XG3.23.72.G06.1.454.CMB.1.raw
  modified_base (436)..(436): a, c, t, g, unknown or other
  misc_feature (436)..(436): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcagaaaccagggaaacgccctaagctcctgatctatgctgcatcctagtttgacaaaggtggggtacccatcgaaggttcagtggcaggtgatcgtagggacagtatttcacttctacaccatcagcagtctgaccaactagaagtatttgactaacttactactgtacaanagtagttacacgttaccccgtactacgtttcggccgtaagggaccaagcgtaggacgaacgtacaaacgtactggtgtacg

SEQ ID NO: 42407 - DNA, 504 bp, Homo sapiens
  misc_feature: GYAE6OF01A4JYR.23.72.G06.1.454.CMB.1.raw
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaanccctaagctccngatctatgctgcatccagtttgcaaagtcgggtccatcaaggttcagtgcagtggatcgtgggacagtatttcgactctcaccatcagctagtctgactaacctgtaagtatttgactaacttactactgtacaactagattacacgtacccgtactacgtttcggccgtagggaccaagcgtacggagtactacgaaaccgactggtgtaccg

SEQ ID NO: 42408 - DNA, 721 bp, Homo sapiens
  misc_feature: GYAE6OF01DPGS0.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctccgtggggctcctgctactctggctccgaggtgccagatgtgacatccagatgacccagtcctccatcctccctgtctgctatcgtgtaggagacagagtcaccatcacgttggccgggacaagtcagagctatagcagtacttaatttaagtgtatcagacaagaaaccgaggaaccaccctaagccttcctagtactctatcgacttcgctacgtccgtagtttacgaacgtaaacgggtcgggtaccctaagtacgtaaacggtttcgaggtcggacgtaggttaggtacgttacggtagggtaactacgttacgtttaccgtaccttaccgtacctaaccgtacttaccgacgtaccgtacgttaccgtaccgtaaccttaaccgttagtaaacgtttacgttttaacgtaaccttaaaccgtttaccgtaaccgttaacgttaaaccgtaaaccgttaacggttaaccgtttaacccgtaacccggtttaaaccccgttaaccgttaaccggttttacccgggaacccgggtaacgggtaaccgtaaacggtacggtaacggaacgtaacgtaaccgtaaacggtaacgttcggtacggtaccg

SEQ ID NO: 42409 - DNA, 461 bp, Homo sapiens
  misc_feature: GYAE6OF01BQNO1.23.72.G06.1.454.CMB.1.raw
  modified_base (444)..(444): a, c, t, g, unknown or other
  misc_feature (444)..(444): n is a, c, g, or t
  modified_base (449)..(461): a, c, t, g, unknown or other
  misc_feature (449)..(461): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggtatctccggaggctactactacatggacgtctggggcaaagggaccacggtcaccgtctcctcagcctccaccaagggcccatcggtcttccccctggcaccctcctccaagacgcacctctggggcacagcggccctgggctgcctggtcaaggactacttccatactcgcgtctgagcgggctggcaaggcncatgnnnnnnnnnnnnn

SEQ ID NO: 42410 - DNA, 470 bp, Homo sapiens
  misc_feature: GYAE6OF01DBQ4F.23.72.G06.1.454.CMB.1.raw
  modified_base (197)..(197): a, c, t, g, unknown or other
  misc_feature (197)..(197): n is a, c, g, or t
  modified_base (456)..(470): a, c, t, g, unknown or other
  misc_feature (456)..(470): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaacccgnggacacagccgtgtattactgtactagagggcacattacgatattttgactggttattctcccggaggctactactacatggacgtctggggcaaagggaccacggtcaccggtctcctcagcctccaccaagggccccatcggtcttcccccctggcaccctcctccaagacgcacctctgggggcacagcggccctgggctgcctggtcaggactactccatactcgcgtctgagcgggctggccaaggcgcatagnnnnnnnnnnnnnnn

SEQ ID NO: 42411 - DNA, 511 bp, Homo sapiens
  misc_feature: GYAE6OF01ENW9V.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctatttaatggtatcagcagaacagggaagccctaagctctgatctatgctgcatccagtttgacaaaggtcggggtacccatacgaaggttcagtggacaggtggatcgtgggacagtatttcgactctcacatcagcagtctgcaactgaatatttcgactaacttactactgtacaacgtagtaacgttacaccgttaccccgtactacgttttacggaccgtaggggacctagacgtggacgtactacaaacgacgtgtggtcg

SEQ ID NO: 42412 - DNA, 495 bp, Homo sapiens
  misc_feature: GYAE6OF01AFY3A.23.72.G06.1.454.CMB.1.raw
  modified_base (321)..(321): a, c, t, g, unknown or other
  misc_feature (321)..(321): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (472)..(472): a, c, t, g, unknown or other
  misc_feature (472)..(472): n is a, c, g, or t
  modified_base (474)..(495): a, c, t, g, unknown or other
  misc_feature (474)..(495): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgacaaatgaacagcctagaaaaccgaggacacagccgtgtattactgtactaggaggcgacattacgattattttgacttggttattccgtccggagctactactacagtggacgtcgtggggacaaacgggccacggtccaccgtcncctcacgcctaccgaccgacggcccacgtccggtcctccccgcgccaccctcctaccgaagcgccaccgtcggcgggcacgcgccgccgtggctcgcgtgacacgtacctactcatccgtcgcgtcgnggcggcggcgnggcgagcacgangnnnnnnnnnnnnnnnnnnnnnn

SEQ ID NO: 42413 - DNA, 461 bp, Homo sapiens
  misc_feature: GYAE6OF01BHCIN.23.72.G06.1.454.CMB.1.raw
  modified_base (456)..(461): a, c, t, g, unknown or other
  misc_feature (456)..(461): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttattctcccggaggctactactacatggacgtctggggcaaagggaccacggtcaccgtctcctcagcctccaccaagggcccatcggtcttcccccctggccacctcctccaacgagcacctctgggggcacagcggccctgggctgcctggtcaagggactacttccatactcgcgtctgagcgggctggcaaggcgcatagnnnnnn

SEQ ID NO: 42414 - DNA, 716 bp, Homo sapiens
  misc_feature: GYAE6OF01DTYDK.23.72.G06.1.454.CMB.1.raw
  modified_base (203)..(203): a, c, t, g, unknown or other
  misc_feature (203)..(203): n is a, c, g, or t
tcagacgcgagtatcacgaccggtgctcgatttagctacgactgcaagggaaagggggcaggagtcagtctcagtcaggacacagcatggacatgagggtccccgctcagctcctgggctcctgctactctggctccgaggtgccagatgtgacatccagatcgacccagtcctccatccctccctgtctgcatctgtagganacagacgtcaccatccacgttcgccgggacaagtcagacgactatagcagtacttaatttaagtggtatacagtacaagaaaccgaggaaacctaccctaagcctacctagactactatcgctcgacctacgtactaggtttacgaacgtaaacgggtccggggtaccctaagttaccgtaaggttccgtaagggttcggacgtaggtacggtagtcggtagggtactagtactttaccgaccgttacctactaaccgatccgaacgtccgtaagttccgtacgacctaacccgttagaacgtttaccttttacgaaccctttaaccgttaaccgttacggttacttaaccgaaacgtaacggttaaccgttaaccggtaaacccgttaccccggttaaccgtttaaccggtttaccggggacccggttaaacggggtaaaccctagggtacccgttaagggtaaccgtacgttaaacccgtaaacggtacccgtttagggtaccggttaccg

SEQ ID NO: 42415 - DNA, 751 bp, Homo sapiens
  misc_feature: GYAE6OF01BKGSN.23.72.G06.1.454.CMB.1.raw
  modified_base (176)..(176): a, c, t, g, unknown or other
  misc_feature (176)..(176): n is a, c, g, or t
tcagacgcgagtatcacgaccggtgctcgatttagctacgactgcaagggaaagggggcaggagtcagtctcagtcaggacacagcatggacatggacgggtccccgctcagctccgtggggctcctgctactctggctccgaggtgccagatgtgacatccagatgacccagtcnccatccctccctgtctgctatctgtaggagacagatcaccatcacgttgccggcaagtcaggagctattagcagtcttaatttaaattggtatcagacaaggaaaccgaagggaaacctccctaagcctactagatctatcgctcgactactaccgtagtttacgacgtaaagggttccgggtacccctaagttacccgtaaaggggttctaacgggtcggtacggtagttcggggtaacgttcggtaacggggtacttaacggttaaccttttacctaacccgtttacccgttaccgaaaccttacgtaaccgtaacggtaccgtaaccgttaccgtaacgtaacccgtaaacccggtttaacgttaaacgttttaccgttttaaccgtaacctttaaacccgtttaaccgttaaccgtttaaccgtaaccgttaaacgtaaccggttaaccgttaaccgttaaccccgttaaccccgtaccgttaacggttttaccgggaaccggtaaccgggtaacccgtaacggtacggtaacggaacgtaacgtaacgtaaacgtaagtcggtcgtaccg

SEQ ID NO: 42416 - DNA, 582 bp, Homo sapiens
  misc_feature: GYAE6OF01CC8FF.23.72.G06.1.454.CMB.1.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatccctccctgtctgcatcgtgtagganacagagtccaccatcacgttggccgggcaagtcaagagcattagcagacttaatttaaagttggtaatcagcaagaaaaccgaagggaaacgcccctaagcctcctagtatctatgctgcactctagtttagacgtaaagggtcggggaccctagtacgtaaaggttcaggtggactaggtcgagtcgtaggggactagtactttcactctacaccatcanctgtctcactaccgagtaattatttgaccttaacttactacgtagtacaactaggtacttaccgtaccggttaccccgtactaaccgtttcgggacccgtaaggggtaccaggtaccgtaggtaacgtaacctaacgaaacggtacgttgtcgggtac

SEQ ID NO: 42417 - DNA, 662 bp, Homo sapiens
  misc_feature: GYAE6OF01ASW82.23.72.G06.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccatcacttggccgganaagtcagagcattagcagtacttaatttaaagttggtatcagtacaagaaaccgaagggaaacncccctaagtcctacctgatctatgactcgcattcctagtttacgacgtaaacggtcggggtaccctaagtaccgtaaggttccgtaaggttcggacgtaaggtcggaattcggtacggggactaggttactttccacgttacctacctaacctataccgtaacgctacgttctaccgtaccaaccgttagtaacgttacgtttacgaacgttaaccttacttaaccgttacgttaaccaacggttacgtaacgttacccgtaaccgttaacccgttaccgttaccggttttacggacccggtacgggtaacctagggtaccgtaagggtaacgtaactaacccggaaaagttacgtacggtccggtaaccg

SEQ ID NO: 42418 - DNA, 666 bp, Homo sapiens
  misc_feature: GYAE6OF01CI9L4.23.72.G06.1.454.CMB.1.raw
  modified_base (286)..(286): a, c, t, g, unknown or other
  misc_feature (286)..(286): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggacaagtcagagcattagcagtctaatttaaattggtatcagcagaaaccgagggaaacncccctaagcctcctagatctatgctgcatcctagtttgacgtaaaggtcggggtaccctagtacgtaacggttcaggtacggcgaggtggtactcggtaggggacctaggttactttaccgacttcctacaaccgtataccgagtcgacgttcctacggacctaacccgtaggtaacgttacttttacggaaccttaaacgtttaccttaaccgttacgttaacctaaacgtaacggttaacgtttaacccgtaaccggtttacccccgttaacgtttacccggttttacgggaccccggtaagggggtaacccctaagggtacccggttagggaaacgttacgtaaccgaaaacggtaaccgtgggttacggtaacccg

SEQ ID NO: 42419 - DNA, 636 bp, Homo sapiens
  misc_feature: GYAE6OF01ALX3E.23.72.G06.1.454.CMB.1.raw
  modified_base (281)..(281): a, c, t, g, unknown or other
  misc_feature (281)..(281): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttaatttaatggtatcagcaagaaaccgaggaacnccctaagcctctagatctatgctgctactccgtagtttcgacgtaaacgggtcgggtacccaagtacgtaacggttcgaggtcggcgtaggtggtacgttcgtacggggtacaggttactttccacgtcctaccacctactcgagactacgtcctacgacctaaccgtggtaacttgtttacgaaccttaacgtttactacgttacgtaactaacgtaagttaacgttaaccgtaaccggtaccccgttaaacgttaccggtttacggacccggtaaacggggaacccgtaaggtaccgttaacggaacgtaaaccgttaccgaaaaccggttaccggtagggttccggtaaccg

SEQ ID NO: 42420 - DNA, 692 bp, Homo sapiens
  misc_feature: GYAE6OF01DC2R2.23.72.G06.1.454.CMB.1.raw
  modified_base (665)..(665): a, c, t, g, unknown or other
  misc_feature (665)..(665): n is a, c, g, or t
  modified_base (668)..(692): a, c, t, g, unknown or other
  misc_feature (668)..(692): n is a, c, g, or t
tcagacgcgagtatcacgaccggtgctcgatttagctacgactgcaagggaaggggctggagtgggtagtttcattagaagcaaagcttatgggtgggacaacagaatacgccgcgtctgtgaaggcagattcaccatctcaagaagatgattaccaaaagcatcgcctatctgacaaatgaacacgaccgtaagaaaccgaggaaccacgacggtacccgttagtatttacctaggtacggtaggacggcgtaacatttacgttatacttttggtactttcggtaccgttacgtcccgtaagtacttacctactacgagttcggtacggggtactaagggggcccaaacggggtcccaacccgggttcctacccggttccttacccgccccgtaccgacccccgtaaccggaccccggtaaacggtccccggtacctttccccccgggttccgttacccccctacccgggtcccctcccctaacccggaccgacgaccctcccgtaccgggtccggaccgggacaccgggcccggcccgggtcgtcggtcctcggtacgacggtacgtaacccgttacctctttaccgcgttacccgggtcgttccgggtacgaccggggtaccgggtccgaccgggtcgggaaccgcggttaccgagacgtcnacnnnnnnnnnnnnnnnnnnnnnnnnn

SEQ ID NO: 42421 - DNA, 530 bp, Homo sapiens
  misc_feature: GYAE6OF01E2FD0.23.72.G06.1.454.CMB.1.raw
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacnccctaagctcctgatctatnctgcatcctagtttgacaaagtcggggtcccatcaaggttcaggtggctagtgtatcgtgggacagtattcactctcaccatcagcagtctgcaactgaatatttcactaacttactacgttgtacaactagtacgttaccacgttaccccgtaactacgtttacgggacccgtaggggtaaccctaggacgtaggtaacgtactaaccgaaaccggacttggtcggtacc

SEQ ID NO: 42422 - DNA, 695 bp, Homo sapiens
  misc_feature: GYAE6OF01EE4HA.23.72.G06.1.454.CMB.1.raw
tcagacgcgagtatcacgaccggtgctcgatttagctacgactgcaaggggaaagggggcaggagtcagtctcagtcaggacacagcatggacatgagggtccccgctcagctcctggggctcctgctactctggctccgaggtgccagatgtgacatccagatcgacccagtctccatcctcctgtctgctatctgtaggagacagtacgtcaccatccacgttcggccgggacaagtcaagagactaattagcagtattaatttaaattgtactacaagacgaacgaaaccgaaggggaaacctacccgtaacgtcctcctagtaactctagtgctgactactctagttgacgtaaacggtcgggtacctatacgtaaggtcgaggtcggacgtagtggattcgggacggtactagtacctttacacgttcctacaacctagtaccgaacgtctaacggttccctagtaaccgttaaaccgttaggtaaagttttacgttttaacgaaccttaaaaccgtttacttaaacgttacgaaaccttaaagtaacggtttaaaccgttaaccgtaacccggtttaaacccccgttagtttaacccggtttaccggggaaccggttaaccggggaactaacgtaccgggtaagaacggtaaaccctaacggtaaaaccggtacttcgggtacgtaccg

SEQ ID NO: 42423 - DNA, 691 bp, Homo sapiens
  misc_feature: GYAE6OF01DDQ7H.23.72.G06.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagacgcgagtatcacgaccggtgctcgatttagctacgactgcaagggaaagggggcaggagtcagtctcagtcaggacacagcatggacatgagggtccccgctcagctccgtggggctcctgctactctggctccgaggtgccagatgtgacatccagatcgacccagtcctccactccctcctgtctgcatctgtaganacagactcaccatcacgtcgccggganaagtcagagctattagactagtacttaaatttaattaggtactacgaagacgtaaacgaaaaccggtaacggaaaccgtacccctaagtcctacgtagtactctagtcgctcgactacgtccgtaagtttcgaacggtaacgggtcgggtacctaacgtacgtaaggtctaggtggacgtacggtagtacgtcggtagggtaactacgttactttacaccgtttaccacctactaagtaccgacgtacctacggtcccttacgcgttaccgtaggtaacgtagtttacgtacgttaactttaaagttttacgtacttaacgttaaactaaacgtacttaaccgtaccggttaccgaccccgggttaccggtaccgggttacccgggaaccgggtaacggggtaacgggtaaacgggtaacgaaacgttaaccgtaaacgtaggtacggtggtccgtaacg

SEQ ID NO: 42424 - DNA, 466 bp, Homo sapiens
  misc_feature: GYAE6OF01BBZ4K.23.72.G06.1.454.CMB.1.raw
  modified_base (431)..(431): a, c, t, g, unknown or other
  misc_feature (431)..(431): n is a, c, g, or t
  modified_base (453)..(466): a, c, t, g, unknown or other
  misc_feature (453)..(466): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttattctcccggaggctactactacatggacgtctggggcaaagggaccacggtcaccggtctcctcagcctccaccaacgggcccatcggtcttcccccctggccaccctcctccaagacgccacctcgtggggcacgagccgccctgggctcgctggcaggctactcatctcgcgtcngagcggctggcaggcgcatagnnnnnnnnnnnnnn

SEQ ID NO: 42425 - DNA, 557 bp, Homo sapiens
  misc_feature: GYAE6OF01EQWPH.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaacgccctaagctcctgatctatgctgcatccagtttgactaaaggtcggggtacccagttacgaaagggtttccaggttcgggcgtaggtggaatcgtaggggactagtactttcacttctacaccatcagcagtctgacaacgtgaagtatttacgactaacttactactagtaccaactagtacgttaccaacgttaccccgtaactaccgttttacggaccgtaacggggacccaagtacgtaggaacgtaacgtacgaaacgtaacgtggtggtaccg

SEQ ID NO: 42426 - DNA, 916 bp, Homo sapiens
  misc_feature: GYAE6OF01B1GY2.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtcctccactccctccctgtctgcatcgtgaggagacagacgtcaccatccacttggccgggacagtcagagactattacgcagtacttaatttaaagttggtatcgagacaacggaaaccgagggaaaccgtaccctaagcctaccgtgtactctatcgctgctatacctagttcgacgtaaagggtccggggtaccctaagtaccgttaaagggttcgaggttacgggacgtagggttacgggtaacgttcgggttaacggggaaccgttaacgggtttaaccttttacccgtaacccgttttaccccgtttaaccccgaaacccttacgttacccgtaaacggtacccgtaaccgggtttacccgttacccggtaaaccctaaaccccgggtttaaggttaaacgggtttttaacccgtttttaaccgggtaaacccttttaaaacccggttttaaacccgtttttaaccccggttaaacggtttaaacccgtaaaacccggtttaaacgggttaaaacccgttttaaacccccgggttaaaaccccggtttaaaccccccccgggtttttaaaacggtttaaccccggggttttttaacccggggaaacccccggggtaaaaccgggggttaacccgggtaaaccggttacccggggttaaaacggggaacccttaaaaccgggttaaaccccggttaaaaaacgggttacccggtttaacggggtaacccgggttaacccgg

SEQ ID NO: 42427 - DNA, 614 bp, Homo sapiens
  misc_feature: GYAE6OF01BJNIN.23.72.G06.1.454.CMB.1.raw
  modified_base (325)..(325): a, c, t, g, unknown or other
  misc_feature (325)..(325): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatcgacccagtctccatcctccctgtctgcatctgtaggagacagacgtcaccatcctacttcggccgggacaacgtcagagctattagcagtcttaatttaaagttggtatcgagacaacgaaaccgagggaaacgcccgtaagctcctgactctatcgactnctactcgtagttacgacgtaacggtcgggtaccagtacgtaagtcgaggtgataggtggattcggtagggactagtacttcgacttctaccgacactcgacgtcacgttctacgaccgtaacgtagtaacgtttagttttaacgtaacctttacgtacgttacgtaacctaagtagttacgttaccgaacccggttaccccgtaacgtttaccgttaccgggacccggtagggtaaccctacggtcggtacggactaacgtaacaaaccggtatcggtacgtctaccgg

SEQ ID NO: 42428 - DNA, 695 bp, Homo sapiens
  misc_feature: GYAE6OF01CBB9Y.23.72.G06.1.454.CMB.1.raw
tcagacgcgagtatcacgaccggtgctcgatttagctacgactgcaaggggaaagggggcaggagtcagtctcagtcaggacacagcatggacatggacgggtccccgctcagctccgtggggctcctgctactctggctccgaggtgccagatgtgacatccagatcgacccagtcctccactccctcctgtctgctatcgtgtaggagacgagacgtaccactatactacgttcggaccgggacaagtcgagacgacgtaattacgactacgtatttaaatttaaagtgtaatcgaagacgaaaaggaaaaccgtaacggggaaacctcccgtaaagtcctaccgtagttactacgtaatcggcttcgaccgtaactaccgttaaggttacgaacggtaaacgggttcgggtaaccctaagtaccggtaaagtcgtaggtacgtagtagggttagtactacgggtaaggaacttaacgttactttaccaccgttacctaccctaactaacgtacgacgtactacgttacaccgtacctaacgtagtaatttacgttacgaacttaacctttcgtaactacgtaacaacgtacgttacgtaaccgtaccgttaccctacgttacggttacggaacccggtaaggacacggttacgaggtaacgtaagtaacccgaaagtacgtggtcgtacccg

SEQ ID NO: 42429 - DNA, 615 bp, Homo sapiens
  misc_feature: GYAE6OF01AUPV5.23.72.G06.1.454.CMB.1.raw
  modified_base (200)..(200): a, c, t, g, unknown or other
  misc_feature (200)..(200): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggcaagtcagagcatagcagctattaatgtatcagcaagaaccaggaaacgccctaagctcctagatctatgctgctatcctaggtttgacgtaaacggtcggggtaccagtcgtaaggttcgaggtacggacgtaggtggaacttcgtaggggactaacggttactttcaacctctaccacgtactcacgactagtcctaggaccctaacctaggtaacgttagttttacgaaccttaacttaccttaacgtacgtaccaaacgtacgtaacgttaaccgtacggttaaccccctaagttaccgttttaccgggacccgtaacgggggtaacctacggtacgtagggtaacgtaaccgtaaccgtaaacggtaaccggttggtacgggtaccc

SEQ ID NO: 42430 - DNA, 657 bp, Homo sapiens
  misc_feature: GYAE6OF01A7WHH.23.72.G06.1.454.CMB.1.raw
  modified_base (291)..(291): a, c, t, g, unknown or other
  misc_feature (291)..(291): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatcacgttgccggacaagtcagagcattagcagtacttaatttaaattggtatcgagacaacggaaaccgagggaaaccnccccgtaagccttaccgtagacttctagtcgtacttgacctactaccgtaggtttacgacgtaaacgggtcgggtaaccctagtacgtaacggtcgaaggtcggacgtaggttagggtacgttacgggtaggaacgtagttactttccgaaccttccgttacccacctaagtacgagacccgtaagtccgttacggaacctaaccgttagtaaagtttcgtttaagaccttaacttaccgtacttagtaacctaacgtaagtaccttaccgtaccgttaaccccgttacttaccggtttacggaccgtacggggacctaggtcgaacggtaagtacgaacgtaaaccgtacgttcggtggtacccg

SEQ ID NO: 42431 - DNA, 559 bp, Homo sapiens
  misc_feature: GYAE6OF01BID6M.23.72.G06.1.454.CMB.1.raw
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(544): a, c, t, g, unknown or other
  misc_feature (543)..(544): n is a, c, g, or t
  modified_base (546)..(559): a, c, t, g, unknown or other
  misc_feature (546)..(559): n is a, c, g, or t
tcagacgcgagtatcacgaccggtgctcgatttagctacgactgcaaggggaaggggctggagtgggtaggtttcattagaagcaaaagcttatgggtgggacaaacagaatacgccgcgtctgtgaaaggcagattcaccatctcaagagatgattccaaaagcatcgcctatctgcaaatgaacagcctagaaaaaccgaggacacagccgtgtattactgtactagagggcaacattacgattattttgacttggttattcgtccggaggctactactacatggacgtcgtggggacaaggggaccacggtcaccgtctcctcacgcctccaccgaacgggcccagtccggtccttcccccgtggccacccctcctccgaagacgccacctcgtcgggggcacgacggccgcccgtcgggctggcccgtcggtacgaacggacctaccgttaccaactaccgtccggtccgtcgtacgggacggccgggctcgggaccgaacgggccgtacacgtacggancgtagcagcngngngnncnngnnnnnnnnnnnnnn

SEQ ID NO: 42432 - DNA, 841 bp, Homo sapiens
  misc_feature: GYAE6OF01BQKSY.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccacctatccacgttcggccgggcaagtcaagacgactattagcgtagtaccttaatttaaacgttggtaactacgaacgaccaaaggtaaaacccgaacggggaaaaccgtccccgtaaagccttaccgtacgtaacttactatcgtacgttacgactacgtacctagtttacgacgtaaacgggttcggggaccctaagtacgtaaggttcgtaaggtcggacaggtggacgttacggtacggggactaaggttacctttacgaccgtttaccgtaccaaccgtacgtacgtaaagccgtaaggttacccgttaccgtaaccgtaaacccgttaagggttaaaacgtttaacgtttttaacggaaacccctttaaaccgtttaaaccgtttaaccgttaacggttaaaccgtaaacgttaaacggttaaaccgtttaaacccggtaaacccggtttaaaccccccgttaaacggtttaaacccgttttaccggggaaacccggttaaacccggggggtaaaccccgttaaaccgggttaacccgggttaaaccgggtaaaaccgttaaacggttaaaacccgggttaaaacccggttaaaccgggtttaccggtaaccggggttaaacccg

SEQ ID NO: 42433 - DNA, 851 bp, Homo sapiens
  misc_feature: GYAE6OF01CC4Z1.23.72.G06.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccaggatgtgacatccagatcgacccagtctccactccctcctgtctgcatctggtaggagacagatcacatcactcgccgganagtcagcacatagcagtacttaatttaaattggtatnagtacgaagaaaccgacgggaaacncccgtaagcctactagtactctatcgctcgctatcctagttgacgtaaggtcgggtaccagtacgtaggtacgtaggtcgtacgtaggtcggtacgtacggtacggggtaactacgttacctttaccgacctttaccgtaaccctaacccgttaacgttaccgtaacgtacccggttaaccggtttacgttaacccggtaaaccgttaaaccccggttaaagggttaaaacccgttttaaacggtttttaaccgtaaaacccgttttaaaacccgttttttaaaccgttttaacccgtttaaccggtttaaaaacccgttaaaccgttaacgggtttaaacccgttttaaaacccggtttaaacccccgggtttaaaccccccggtttaaaccggttttaaaccccgggttttttaacccggggaaacccggggttaaacccgggggtaaaacccggtaaccggggttaaacccgggttaacgggtaaaaccggttaaaccggttaaaacccgttaaaacccggggttaaccggttaaccgggttaccgggtaaaccccgg

SEQ ID NO: 42434 - DNA, 786 bp, Homo sapiens
  misc_feature: GYAE6OF01ECNG1.23.72.G06.1.454.CMB.1.raw
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (678)..(678): a, c, t, g, unknown or other
  misc_feature (678)..(678): n is a, c, g, or t
  modified_base (741)..(741): a, c, t, g, unknown or other
  misc_feature (741)..(741): n is a, c, g, or t
tcagacgcgagtatcacgaccggtgctcgatttagctacgactgcaaggggaaagggggcaggagtcagtctcagtcaggacacagcatggacatggacgggtccccgctcaggcctccgtggggcctcctgtcctaccttccgtcggtccgtaccggtggcgacgtaagtgttgacgaactacctaccgaagtacgtaccgacccgtacgttcccacctccttccccttccgtcgttcgtaccgacttaccgtacgttacggaacggacgacgtaacgtacctaccaaccgtacgttaccgtcggttcccggacggtaacgtaacgacgtaacgtactacgttaagtaacggtaacctttaagtttaaacgttttaaaaggtttacggttagttaaaccacggaaccgtaaacgaaaaccggaaaccggtaaaccgtaccccgttaaccgttacgtacccttagtaagtaccttagttacggcctacgtaccccttagacccgtttaggtaagttaccggaaggttaacgggttcccagttaacgtaccggtaagttggaccggtgtcgtaaaggtctacgttggaacgttatactacgtcctacgtnaccncgtagccgtagtctacgtaccacgtaaactggtacttagtactaccatttactcgattaccgaanacgttacacccgttcgtaaccttcggtcgtaacccggtaggcccggttaaagcttaaccgggnttaaacgggctaaacggtaccttagggtacctgggacttaacccg

SEQ ID NO: 42435 - DNA, 758 bp, Homo sapiens
  misc_feature: GYAE6OF01A8UVU.23.72.G06.1.454.CMB.1.raw
  modified_base (494)..(494): a, c, t, g, unknown or other
  misc_feature (494)..(494): n is a, c, g, or t
tcagacgcgagtatcacgaccggtgctcgatttagctacgactgcaagggaaagggggcaggagtcagtctcagtcaggacacagcatggacatggagggtccccgctcagcctccgtggggctcctgctactctggctccgaggtcgccagatgtagacatccgagatcgacccagtcctaccacttccctcctgtctcgcattcgtaggtacggagtacgagtacgtaccaaccgacttccaaccgttcgggacccgggtactaaagggtccaaggactacgtaacttacggaccctaggttactttaaagttttaaaggtcggttaactacgaacggaccaaaaggtaaaacccggtacggaaaccgtacccctaacggtccttaccgtaaggtaccttacgtagtccgtcgttacgtacccacgttaccgttagttcgaaccggtaacggtccggtactacgtagtacggtcgacgtggacgtaggcgtntacggtacggactaggtacttacctacgtacctacccgtaactcgtaaccgacgtcgtacgtaccgtccgtaacctacgttaacgtaagttacttacgtaaccgttaaccttaccgttaacgttaccgtaacttaacgtaacgttaccgtaacctaacccggttaacccttaccggtaccggtttaccgggacccggtaacggtaccgtaacggtaccgaggttaaccgtaacgtaaccgtaaaggtcggtaacgtcggtaccg

SEQ ID NO: 42436 - DNA, 727 bp, Homo sapiens
  misc_feature: GYAE6OF01AJ23M.23.72.G06.1.454.CMB.1.raw
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (693)..(693): a, c, t, g, unknown or other
  misc_feature (693)..(693): n is a, c, g, or t
  modified_base (702)..(702): a, c, t, g, unknown or other
  misc_feature (702)..(702): n is a, c, g, or t
  modified_base (709)..(709): a, c, t, g, unknown or other
  misc_feature (709)..(709): n is a, c, g, or t
  modified_base (713)..(713): a, c, t, g, unknown or other
  misc_feature (713)..(713): n is a, c, g, or t
  modified_base (718)..(718): a, c, t, g, unknown or other
  misc_feature (718)..(718): n is a, c, g, or t
  modified_base (721)..(721): a, c, t, g, unknown or other
  misc_feature (721)..(721): n is a, c, g, or t
  modified_base (726)..(727): a, c, t, g, unknown or other
  misc_feature (726)..(727): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattaccaaagcatcgctatctgcaaatgaacagacctagaaaccgaggacacagccgtgtaagttactagtaacgtaggagggacgaacctagttacgatttacgttttacgacgtttaggtttacttacccgtcccggaggtaccttaaccgttacctaaccgagttacgggtaccggttcggtacgggggacgtaaaacggggtacccaaccgggtacctaacccggttcctccgtaccgtacgaccctacccgaacccgaaccggggtacccacgttccggtcccttcccccgtacggccctacccctaccgtaccaacgacgcctaccgtcggtacggggtacaccggacggccgggtccccgtacgggccgttcggacccgttacgggtaccgtaacgggtacctaccggttaccctaacgttaaccgttcccggtaccggttaccgttacgggtacggggacccgggtaccggttacgggaaccggtaacgggacccggacgtaaccgtaggacagtcgtcncganacgacncncgngcgacgacngatacgnacanacacncanactgnn

SEQ ID NO: 42437 - DNA, 622 bp, Homo sapiens
  misc_feature: GYAE6OF01EIOLY.23.72.G06.1.454.CMB.1.raw
  modified_base (143)..(143): a, c, t, g, unknown or other
  misc_feature (143)..(143): n is a, c, g, or t
  modified_base (236)..(236): a, c, t, g, unknown or other
  misc_feature (236)..(236): n is a, c, g, or t
  modified_base (573)..(573): a, c, t, g, unknown or other
  misc_feature (573)..(573): n is a, c, g, or t
  modified_base (586)..(586): a, c, t, g, unknown or other
  misc_feature (586)..(586): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (612)..(613): a, c, t, g, unknown or other
  misc_feature (612)..(613): n is a, c, g, or t
  modified_base (615)..(615): a, c, t, g, unknown or other
  misc_feature (615)..(615): n is a, c, g, or t
tcagacgcgagtatcacgaccggtgctcgatttagctacgactgcaagggaaaggggcaggagtgggtaggtttcattagaagcaaagcttatggtgggacaacagaatacgccgcgtctgtgaaaggcagattcaccatctnaagagatgattaccaaaagcaatcgcctatctgcaaaatgaacagtcctagaaaaccgaggacacagccgtagtattactgtactagacgggncaattacgattattttgacttggttacttccgtacccggaggctactacgtacatggacgtctggggtcgaaaaggccgtaacggtccgaccgtcctcctcacgcctcccaacaacgggcccagtccggtaccttccccctcggaccacccgtcctaccgaacacgcgtaccctcgtcgggggtcaccgagcccgggtaccgcggggtctcggcccgttggtaaccgaacgggtaccttaccgttacccgtactaacccgtcggtccgttaccgtgggtacggcccgggtcggtcggtaaccgaacggtaccggaccgtaagtaggtaggatcgaangagtgtacgacgnctagnngngtnagcgagtacacgtannanatgtgcg

SEQ ID NO: 42438 - DNA, 514 bp, Homo sapiens
  misc_feature: GYAE6OF02HEUCJ.23.72.G06.1.454.CMB.1.raw
  modified_base (509)..(509): a, c, t, g, unknown or other
  misc_feature (509)..(509): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacgcccctaagctcctgatctatgctgcatccagtttgacaaagtcgggtaccatcaaggttcagtggcagtggatcgtgggacagtatttcactctcacctatcagcagtctgacaacctgaagtatttgactaacttactactcgtacaacgagtagttaacacgttaccccgtataccgtttcggaccgaacgggtacaacgcgtaggacgataccgaaacgtactaggngtacg

SEQ ID NO: 42439 - DNA, 213 bp, Homo sapiens
  misc_feature: GYAE6OF02GLO5P.23.72.G06.1.454.CMB.1.raw
  modified_base (212)..(213): a, c, t, g, unknown or other
  misc_feature (212)..(213): n is a, c, g, or t
tcagacgcgagtatcacgaccggtgctcgatttagctacgactgcaagggaaagggaccacggtcaccgtctcctcagcctccaccaagggcccatcggtcttccccctggcaccctcctccaagagcacctctggggcacagcggccctgggctgcctggtcaaggactacttccatactcgcgtctgagcgggctggcaaggcgcatagnn

SEQ ID NO: 42440 - DNA, 458 bp, Homo sapiens
  misc_feature: GYAE6OF02I382V.23.72.G06.1.454.CMB.1.raw
  modified_base (452)..(458): a, c, t, g, unknown or other
  misc_feature (452)..(458): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatccgcaaatgaacagcctgaaaaccgaggacacagccgtgtattactgtactagagggcgacattacgatattttgactggttattctcccggaggctactactacatggacgtctggggcaaagggaccacggtcaccgtctcctcagcctcaccaagggcccatcggtcttccccctggcaccctcctccaagagcacctctggggcacagcggccctgggctgcctggtcaaggactacttccatactcgcgtctgagcgggctggcaaggcgcatagnnnnnnn

SEQ ID NO: 42441 - DNA, 526 bp, Homo sapiens
  misc_feature: GYAE6OF02HV280.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgctaaagtcgggtcccatcaaggttcagtggcagtgatcgtgggacagatttcactctcaccatcagcagtctgctaactgtaagtattttgactaacttactactgtacaacagtagttaacacgtaccccgtactaccgttttcggaccgtaacggggacccaaggtcgtagggacgtaactaccgaaaccgtaacgttcggtaggtaccg

SEQ ID NO: 42442 - DNA, 462 bp, Homo sapiens
  misc_feature: GYAE6OF02HPMUS.23.72.G06.1.454.CMB.1.raw
  modified_base (454)..(462): a, c, t, g, unknown or other
  misc_feature (454)..(462): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctagaaaaccgaggacacagccgtgtattactgtactagagggcgacattacgatattttgactggttattctcccggaggctactactacatggacgtctggggcaaagggaccacggtcaccgtctcctcagcctccaccaagggcccatcggtcttcccactcggcaccctcctccaagagcacctctgggggcacagcggccctgggctgcctggtcaaggctacttccatactcgcgtctgagcgggctggcaaggcgcatagnnnnnnnnn

SEQ ID NO: 42443 - DNA, 527 bp, Homo sapiens
  misc_feature: GYAE6OF02GPVCG.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtcgggtccatcaaggttcagtggcagtggatcgtgggacagtatttcactctcacatcagcagtctgcaacctgaagtatttgctaacttactactgtacaacgtatagttaacacgtaccccgtactacgttttcgggacccgtaacggggtaccaacggtcgtagggaacgtacgtaaccgtaaacggaaccgttggtaggtaccg

SEQ ID NO: 42444 - DNA, 500 bp, Homo sapiens
  misc_feature: GYAE6OF02FXGN9.23.72.G06.1.454.CMB.1.raw
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtccatcaaggttcagtgcagtggatcgtgggacagatttcactctcacntcagcagtcngcaacctgaagtntttgactaacttactactgtacaacagtattacagttaccccgtactacttttcggaccagggtaccaaggtctagggacgtacgtacaaacgtactagtggtac

SEQ ID NO: 42445 - DNA, 528 bp, Homo sapiens
  misc_feature: GYAE6OF02G9OM3.23.72.G06.1.454.CMB.1.raw
  modified_base (279)..(279): a, c, t, g, unknown or other
  misc_feature (279)..(279): n is a, c, g, or t
  modified_base (352)..(352): a, c, t, g, unknown or other
  misc_feature (352)..(352): n is a, c, g, or t
  modified_base (396)..(396): a, c, t, g, unknown or other
  misc_feature (396)..(396): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaancccctaagctctgatctatgctgcatccagtttgacaaagtgggtacccatcaaggttcagtgcagtgatcgngggacagtatttcactctcacatcagcagtctgcaacctgaatntttagactaacttactactgtacaactagtacgttacacgttaccccgtactacgttttaggacccgtaacggggaacctaaggtacgtagggaacgtaacgtacctaaaacggtacgttggtacggtaccg

SEQ ID NO: 42446 - DNA, 509 bp, Homo sapiens
  misc_feature: GYAE6OF02GEIWW.23.72.G06.1.454.CMB.1.raw
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaatgtatcagcagaaaccaggaaagcccctaagctcctgatcatgctgcatccagtttgactaaagtgggtcccatcaggttcagtgcagtgatcgtgggacagtatttcactctacacatcagcagttcngcaacctgaatatttgactaacttactactgtacaaactgtaacttacaacgttacccgtactacgttttacggaccgaacgggtaccaagtcgtagganacttaaccgaaacgtaacgtgtggtaccg

SEQ ID NO: 42447 - DNA, 807 bp, Homo sapiens
  misc_feature: GYAE6OF02H7LBT.23.72.G06.1.454.CMB.1.raw
  modified_base (226)..(226): a, c, t, g, unknown or other
  misc_feature (226)..(226): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggganaagtcagagcattagcagctatttaaattggtatcagacaagaaaccaaggggaaacgaccccgtaagcctacctgatctaatcgctgcatccgtagtttgactaaaggtcggggtaccctagtacgtaaaggtttccgaacgggtggtaccgaagggttcgggtaacgtttaccggttagggggtaacccgttaagggtaacgttttttaccccgtaaccgtttacccttacctaaacccgtaacgttaccgtaacggtcccgttaagttcccgtttacggacccgtaaaacccgtttacggttaaaacgttaacggttttttacggtaacctttaaaacccgttttaaccttaacccgtttacggttaacccgtaaaaccgttaacggttaaaccggttttaaacccgtaaacccggttaacccccggtttaaccgtttaacccggttttttaacggggaaccccgggttaaaccgggggtaaacccgttaaaccgggtacccggttaacggggtaacggtaaccggttaaacccggtaaaaccggtaaaccggtttacgggttaccgggtaaccccgg

SEQ ID NO: 42448 - DNA, 545 bp, Homo sapiens
  misc_feature: GYAE6OF02IXBCW.23.72.G06.1.454.CMB.1.raw
  modified_base (281)..(281): a, c, t, g, unknown or other
  misc_feature (281)..(281): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagtcaagaaaccagggaaacnccctaagctcctgatctatgctgcatcagtttgacaaagtgggtccatcaaggttcagtgcagtggactgtgggacagtatttcgactctacaccatcagctagtctacgcaaccgtgtaaagtctttacgacttaacttactactcgtacaaacgtagtaacgttaacctaacgttaccccgtacgttaccgttttacggacccggtaacgggacctaagtcgtacggaacgtacgtaccgaaacgtaacttaggtcgtaccg

SEQ ID NO: 42449 - DNA, 555 bp, Homo sapiens
  misc_feature: GYAE6OF02HOOP9.23.72.G06.1.454.CMB.1.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaattggtatcagcaagaaaccagggaaacncccctaagctacctgatctatgctgcatccagtttgacaaagtcgggtccatcaaggtcagtggcagtgatcgnggacagtacttnactactcacatcagcagttctgcaactataagtatttcgactaacttactactacgtactaaacacggtacttaacgaacgttaccccgttacttaccgttttaccgggaaccgtaccgggggtaacctaacggtccgtaacgggtacgtaaccgtaaccgaaaccggtaacgttggtacggtaccg

SEQ ID NO: 42450 - DNA, 554 bp, Homo sapiens
  misc_feature: GYAE6OF02IUHT7.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatccacttcgccgggcaagtcagagcattagcagctaatttaaattggtatcagcagaaaaccaggggaaacgccctaagcctcctgactctatgctgcatccagtttcgacgaaaggtcgggtcccaatcgaaaggttcaggtggctaggtggtactcgtagggactaggtatttcactctcaccatcagcagttctgaccaacgtgaacgttatttacgacttaacttactacgttatacaacgtaagtacttaacgtaccgtacccgtacttacgttttacggaccgtacgggaccaacgtcgtggtaacgacgtaacgaacgtaacgtacggtcgtacg

SEQ ID NO: 42451 - DNA, 540 bp, Homo sapiens
  misc_feature: GYAE6OF02FFXIA.23.72.G06.1.454.CMB.1.raw
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
  modified_base (519)..(540): a, c, t, g, unknown or other
  misc_feature (519)..(540): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattaccaaaagcatcgcctatctgacaaatgaacagacctagaaaaccgnggacacacgccgtagtacttactgtactaggagggcactattacgattatttgacgttggttactcgtcccggagctactactacagtcggacgtcgtaggggacgaacgggacctaccggtcaccgtcctcctcacncctaccgaccgaacggccctacgtccggtcccttcccccgtgaccctacccgtcctaccaagcnccgtaccgtcggtacggggccacgacggccggcccgtcggctcgccgtacgtacgaacgtacctacctccactaccgtcgtcgtcgnggcggcggcgtacggacgaacgcgnaagtnnnnnnnnnnnnnnnnnnnnnn

SEQ ID NO: 42452 - DNA, 214 bp, Homo sapiens
  misc_feature: GYAE6OF02FZUCC.23.72.G06.1.454.CMB.1.raw
  modified_base (212)..(214): a, c, t, g, unknown or other
  misc_feature (212)..(214): n is a, c, g, or t
tcagacgcgagtatcacgaccggtgctcgatttagctacgactgcaagggaaagggaccacggtcaccgtctcctcagcctccaccaagggcccatcggtcttccccctggcaccctcctccaagagcacctctggggcacagcggccctgggctgcctggtcaaggactacttccatactcgcgtctgagcgggctggcaaggcgcatagnnn

SEQ ID NO: 42453 - DNA, 531 bp, Homo sapiens
  misc_feature: GYAE6OF02JCXM0.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaacgcccctaagctcctgatctatgctgcatccagtttgcaaagtgggtcccatcaaggttcagtggcaggtgatctgggacagtactttcactctcacctatcagcagtctgacaacctgaagtattttagactaacttactactgtacaacagtacgttaacacgtaccccgttactacgttttcggccgtaacggggacctaaggccgtagggacgtactaaccgaaaccggtaacgttcgggtaggtaccg

SEQ ID NO: 42454 - DNA, 536 bp, Homo sapiens
  misc_feature: GYAE6OF02IJ1G9.23.72.G06.1.454.CMB.1.raw
  modified_base (226)..(226): a, c, t, g, unknown or other
  misc_feature (226)..(226): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaatggtatcagcaagaaaccagggaaacgcccctaagctcctgatctatgctgcatccagtttgacgtaaaggtcggggtacccagtacaaggttcaggtggacaggtggatcgtgggactagtatttcactctcaccatcagcagtctgacaacctgtaatatttgactaactttactacttagtacaactagtacgttaacacgttaacccgtacttacgttttacggccgtaacgggaccaaggtcgtaggacgtacgtaccaaacgtacgtggtagtaccg

SEQ ID NO: 42455 - DNA, 469 bp, Homo sapiens
  misc_feature: GYAE6OF02JFL8S.23.72.G06.1.454.CMB.1.raw
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
  modified_base (459)..(469): a, c, t, g, unknown or other
  misc_feature (459)..(469): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttatctcccggaggctactactacatggacgtctggggcaaagggaccacggtcaccgtctcctcagcctcaccaagggcccatcggtccttcccccctggccaccctccctccaagagcacctctcgggggcacagccggccctgggctgccgtggtcaaggactacgttccatactcgcgtcngacgcggctggcaggcgcntagnnnnnnnnnnn

SEQ ID NO: 42456 - DNA, 505 bp, Homo sapiens
  misc_feature: GYAE6OF02JDR5Q.23.72.G06.1.454.CMB.1.raw
  modified_base (487)..(505): a, c, t, g, unknown or other
  misc_feature (487)..(505): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttattctccggaggctactactacatggacgtctggggcaaagggaccacggtcaccgtctcctcagcctccaccaacgggcccactccggtccttcccccctcggccacccgtccctcccaacgacgccacctcgtcgggggcacgacgcggcccgtgggctcgcctggtcaacggacttacgttccatacctcgtccgtctggacgcgggtctggacaacgggccgcagtgagnnnnnnnnnnnnnnnnnnn

SEQ ID NO: 42457 - DNA, 732 bp, Homo sapiens
  misc_feature: GYAE6OF02G4NR9.23.72.G06.1.454.CMB.1.raw
tcagacgcgagtatcacgaccggtgctcgatttagctacgactgcaagggaaagggggcaggagtcagtctcagtcaggacacagcatggacatgaggtccccgctcagctccgtggggctcctgctactctggctccgaggtgccagatgtgacatccagatgacccagtctccatcctcctgtctgcatctgtaggagacgagagtacaccatcctacgttcggccgggtcaagtcagagcattgcagtacttaatttaatggtaatcagcgtaacgaaaccgagggaaacaccccgtaagtccgtcctagactctaatcgctgtccactccgtagttggacgtaaaggttcgggtccctaagtacggtaacggtttacgtacggtcggtacgtaggttacgggacttacgggtacggggaacctaagttacgttttaccaaccgttacccgtaccgaacccttaaacttaccgaaaccggtcgttaacggttacccgtacgtaacccgttaaacccgtaaggtaaacggtttactttaacccggtaacttaaacccggttttaccttaacgttaccgtaacgtaaaccggtaacgttaaaccgttaaccgttaacccgttaaccccgggttacttaccgggttttaccgggaacccggtaacggggaacccgtaggtaccgtaggaacgtaccgtaaaccgtaaaccggtacggtcggtacgtacccgg

SEQ ID NO: 42458 - DNA, 556 bp, Homo sapiens
  misc_feature: GYAE6OF02JCURK.23.72.G06.1.454.CMB.1.raw
  modified_base (227)..(227): a, c, t, g, unknown or other
  misc_feature (227)..(227): n is a, c, g, or t
tcagacgcgagtatcacgaccggtgctcgatttagctacgactgcaagggaaagggggcaggagtcagtctcagtcaggacacagcatggacatgagggtccccgctcagcccctggggctcctgctactctggctccgaggtgccagatgtgacatccagatgacccagtctccatcctccctgtctgcatctgtaggagacagagtcaccatcacttgcccgggnaagtcagagcattagcagctatttaaattggtatcagcagaaaccagggaaagcccctaagctcctgatctatgctgcatcctagtttgcgaaagtcgggggtaccactcaaggttcgagtggctaggtgatcgtgggacagtatttcactctcaccatcagcagtctgacaacctgaatatttgactaacctttacacttagtacaacgtagtaacgttacgtaaccgttacccgtaacgttacgttttacggaccgtaacggggtaaccaaggtaccgttaggtaacgaacttaccgaaaaccgaacgtttcggtacggtcgtaccg

SEQ ID NO: 42459 - DNA, 558 bp, Homo sapiens
  misc_feature: GYAE6OF02IGSJZ.23.72.G06.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (403)..(403): a, c, t, g, unknown or other
  misc_feature (403)..(403): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcacatcacttggccggnaagtcagagcattagcagctaattaaattggtatcagcaagaaaccaagggaaacgacccctaagcctcctagatctaatgctgctactccagtttcgacgtaaaaggtcggggtacccagtacgtaaggttcaggtgcgaggtgtagtcgtaggacagtattcactactcacatcancagtctgacaactagtagtatttcgactaacttactactgtacaacaagtaacgttaccacgtaccccgttacgttaccgttttacggaccggtaacgggacctaacggtcgtaggtacgagttaaccgaaacggtaacgttacggtaggtaccg

SEQ ID NO: 42460 - DNA, 477 bp, Homo sapiens
  misc_feature: GYAE6OF02GAHEI.23.72.G06.1.454.CMB.1.raw
  modified_base (349)..(349): a, c, t, g, unknown or other
  misc_feature (349)..(349): n is a, c, g, or t
  modified_base (455)..(455): a, c, t, g, unknown or other
  misc_feature (455)..(455): n is a, c, g, or t
  modified_base (459)..(460): a, c, t, g, unknown or other
  misc_feature (459)..(460): n is a, c, g, or t
  modified_base (462)..(477): a, c, t, g, unknown or other
  misc_feature (462)..(477): n is a, c, g, or t
tcagacgcgagtatcacgaccggtgctcgatttagctacgactgcaagggaagggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcacattacgatattttgactggttattctcccggaggctactactacatggacgtctggggcaaagggccacggtcaccggtctcctcagcctccaccaagggcccatcggtcttcccccnggcaccctcctccaagcgcacctcgtcgggggcacgacgcggccctggggcctcgccgtggtccaaggctactccatacgtcgcgtctgagcggtctggcaggcgnatgnngnnnnnnnnnnnnnnnn

SEQ ID NO: 42461 - DNA, 623 bp, Homo sapiens
  misc_feature: GYAE6OF02G88EQ.23.72.G06.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagngctattagcagtcttaatttaaattggtatcgagacaagaaaccgagggaaacnccctaagcctcctgatctancgctgacagtcctagtttacgacgtaaacggtcgggtacccagttacgtaaggttcgaggtaggactaggttaggtagtcggtagggtaactaggtactttcgaaccttccgtacctacctatccgtaacgccgtagtctacgactaacgtagtacgtagtttacgaacttaaccttactacgtacgtaacctaaagtacgttaccgtaaccgtaccgttacccgtaccgttacgtttacggaaccggtaacggggtaaccctaaggtcgtaacggtacgtacgttaaacgaaccgtacgtacggtacggtaccg

SEQ ID NO: 42462 - DNA, 639 bp, Homo sapiens
  misc_feature: GYAE6OF02FHNYU.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccgagggaaacgcccctaagcctcctgatctatgctgctatcctagtttcgacgtaaaggtcggggtacccagtacgtaaggttcaggtgacgagtggatcgtagggacagtactttacgaccttctacctaacctactccgacgtctaacggttctacgtacctaaaccgtggtaaacgttatttttacgaccttaaacgtttacttaacgttacgtaacctaaacgtaagtaacgtttaacctaaccgtttaacccccgttacgttaccgttttaccgggacccgtaacgggggtaaaccctaacggttcgtaacgggtacgttaacgtaacccgtaaaacggtacgttacgggtacggttaccg

SEQ ID NO: 42463 - DNA, 701 bp, Homo sapiens
  misc_feature: GYAE6OF02GCMU6.23.72.G06.1.454.CMB.1.raw
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
tcagacgcgagtatcacgaccggtgctcgatttagctacgactgcaagggaaagggggcaggagtcagtctcagtcaggacacagcatggacatgagggtccccgctcagctccgtggggctcctgctactctggctccgaggtgccagatgtgacatccagatgacccagtctccatccctccctgtctgcatctgtagagacagagtacaccatcacttgccgggnaagtcagagcattagcagtcttaatttaattggtatcagcaagaaaccgagggaaaccncccctaagccttacctagatctatgactgacctataccgtagttgactaaacgggtcgggtaccctagtacgaaggtttcaaggttggacgtaggttggtacgttcgtagggtacgtagttacgtttacaccgttacctaccgtaacctacgttaccgacgtacgtaacgttactacgtaccgtaaaccgttagtaaacgtttagttttaccggtaaaacttaaccgtttaaccttaaccgttactaaccgtaaacgtaacggttaaaccgttaacccgtaaccgttaacccccggttacgttaaccggttttaccggggaacccggttaaccggggtaacccgtaaacggtacggttaacggtaaccggtaacgttaacccggtaaacggtaacgttacggtacggtacccgg

SEQ ID NO: 42464 - DNA, 771 bp, Homo sapiens
  misc_feature: GYAE6OF02JI9BP.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatcgacccagtctccatcctccctgtctcgcatctgtaggagacagacgtcaccatcaccttcggccgggacaagtcagagctatagcagtctaatttaatggtatcagctaacggaacgaagggaactacccctaagtccttaccgtagacttactacgtcgtacgtgacctagtccgtagtttcgaacgtaaacgggttcgggtaccctaagttaccggtaacggttacgtaggtacggtacgtaagggtggtaactcgggtaacgggtacctacggtttaatttcgtaacccttcgttacccaacctacgttacgtaacgacgttagtcctacgtaccgtaaaccgttggtaaacgttttacgtttacgaacccgttttaaaccgtttaaccgtttaaccgttacgttaaacccgtaacgttaaacgggttaaccgtttaaacccgttaacccggtttaacccccggtttaaccgttttaaccgttttacccgggggaacccgggttaaaccgggggttaaacccaacggtttaccggtaaccggttaacggtaacccgtttaaacggaaacccgggtttaacgttacggttacccgggttaacccg

SEQ ID NO: 42465 - DNA, 760 bp, Homo sapiens
  misc_feature: GYAE6OF02IUTI6.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctccgtggggctcctgctactctggctccggaggtgccagatgtgacataccagatcgaccctagtcctccactccctccttgtctgcattcgtaggtaagagacaggacgtaccaacctataccacgttcggaccgggacaagtcgaagagacctaattacgactaacgttactttaaagttttaaatttagggttaatacgtaacggaactaaaaacggtaaaaccccggaaaggggaaaacccggtacccccgtaaaacggtccgttaacccgtaggtaacgttacttacgtacgtactacgacctaacgttacccgtaggtttaacgaacgtaaaggggttcccggggtacctaagttaacgtaaaggttcgaaggtcggacgtaaggtacggtacgttacggtaggggtactaaggtacttttaccacttcactaactattaacacgtactaacggttacacggtaacctaacgttacgtaagttaccttaagaaaccttaaaccttacttaacgtcgtaaacgaacgttacgaaccgttaaccgaacccgttacccgttacgtttacgttacgggtaccggtaacggtaaaccgtacggtaaccgtaggtactaaacgtagaaaccggtcgtacggtcgtaacg

SEQ ID NO: 42466 - DNA, 604 bp, Homo sapiens
  misc_feature: GYAE6OF02JFBCO.23.72.G06.1.454.CMB.1.raw
  modified_base (153)..(153): a, c, t, g, unknown or other
  misc_feature (153)..(153): n is a, c, g, or t
  modified_base (177)..(177): a, c, t, g, unknown or other
  misc_feature (177)..(177): n is a, c, g, or t
  modified_base (364)..(364): a, c, t, g, unknown or other
  misc_feature (364)..(364): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
  modified_base (552)..(552): a, c, t, g, unknown or other
  misc_feature (552)..(552): n is a, c, g, or t
tcagacgcgagtatcacgaccggtgctcgatttagctacgactgcaagggaaagggggcaggagtcagtctcagtcaggacacagcatggacatgagggtccccgctcagctccgtggggcctccgtgctactctggctccgaggtcgccagntgtcgacactcgagatcgaacccngtcctccactccctcctcgtctgcctatcgttggaggacgtacagtacgtaccaacctatccgtacgttccggccgggactaacggtcaggacgactagttaggacagtacttaatttaagttcggtatacaggactaaggaaccggaggaacctaccctaacgcctaccgtagtactactagtcgntacggactaccgtacgtaggttacgacgtaacgggttcgggacctagtacgtaacgtacggaggtacgcgtaggtcggtatcgggagagtgtaacgttanccgtntccagatccancgtacgntacgccgtaanctagtacgttcaactacctatagtcgaactanaaccgtntaccgacttacccgngttaccggtacgtcggacgacgactagagacgtactacgaagtcgtgtagac

SEQ ID NO: 42467 - DNA, 671 bp, Homo sapiens
  misc_feature: GYAE6OF02G87MN.23.72.G06.1.454.CMB.1.raw
  modified_base (203)..(203): a, c, t, g, unknown or other
  misc_feature (203)..(203): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatcgacccagtctccatccctccctgtctgcatctgtagganacagatcaccatcacgttcgccgggacaagtcagagcattagcagtacttaatttaaagtggtatcgagacgaacgaaaccgagggaaccgccctaagtcctcctgacttctatcgtctgtactactcgtagtttacgacgtaaacggtcgggtaccctagttaacgtaacggttcgacggtcgggtacgtagggtacggtacttacgggtacggggtaacgtaagtttaccgtttctaccgttcctaccaacccgtataccgacgaccgttagtccgtacgactaaccgtaggtaactttacgtttacgaaccttaacttaccgtactacgtaacctaaacgtacgtaacgttaaccgtacccgttacccgttacgttaccggtttaccgggaaccggtaaccgggaacgtaccgtacggttaggtaacgtacgttaaaccgaacgttacggtaggtacggtaccgg

SEQ ID NO: 42468 - DNA, 610 bp, Homo sapiens
  misc_feature: GYAE6OF02HPJ6F.23.72.G06.1.454.CMB.1.raw
  modified_base (171)..(171): a, c, t, g, unknown or other
  misc_feature (171)..(171): n is a, c, g, or t
  modified_base (264)..(264): a, c, t, g, unknown or other
  misc_feature (264)..(264): n is a, c, g, or t
  modified_base (590)..(592): a, c, t, g, unknown or other
  misc_feature (590)..(592): n is a, c, g, or t
  modified_base (594)..(610): a, c, t, g, unknown or other
  misc_feature (594)..(610): n is a, c, g, or t
tcagacgcgagtatcacgaccggtgctcgatttagctacgactgcaagggaaggggctggagtgggtaggtttcattagaagcaaagcttatggtgggacaacagaatacgccgcgtctgtgaaaggcagattcaccatctcaagagatgattccaaaagcatcgcctatntgcaaatgaacagcctagaaaaccgagacacagccgtgtattactgtactagacggcgaacattacgattatttgattggttatcctaccggngctactactacatcggacgtcgtgggacaaacgggacccaggtaccgaccgtctcctcgacgtcctaccaccgaacggcccaagtccggtcctttcccccgtcggcctaccccgttccctaccaacgacgtacctacgtcggtacgggggcctacgaacggcccggtacccggtcgggaccgttcggtacccgtttacggaccgtaaacgggttaacccttaaccgttcccaacttaccgtccgtccgttcgttacgggacggtaccgggtcgtacgggtaaccgaagggtaccggtacacgttaacgactcgactagctgcgacnnngnnnnnnnnnnnnnnnnn

SEQ ID NO: 42469 - DNA, 810 bp, Homo sapiens
  misc_feature: GYAE6OF02F2ZS7.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtagacatccagatgacccagtctccatcctcctgtctgcatctgtaggagacagagtcaccatcacttcggccgggtacaagtcagacgacagttagcagtacttaaatttaaagttaggttaatacacggacaaacgtaaaacccggaagggaaacgtacccccgtaaacggtcctaccgtagtaacgttacttagtacgtcgtagaccgtacttaccgtaggtttacgaaccggtaaacgggttaccggggtaccctagttaacccgtaaagggttcgtaacggtagggtaaccgtaaggggtacggtacgtttaacccgggtaggggtaaccgtaagtttaacgtttacctaccgttacttacccgaacttactaccacgtacgacgttacgtacgtaacccgtaaccgttacgtaaacggtttactttaacgggttaacccttaaacgttttaaccgttaaccgtttaacgttaaccgtaaacggttaaaccgttaacggttaaaccgttaaacccgggtaaccccgttttaaccggttaaccgtttttaacccggggaaccgggttaacccggggtaaacgtaacggtaccgttaacggggaagttaacccggttaaacgaaaccggtaaccggttacgggtagttaaccccgg

SEQ ID NO: 42470 - DNA, 700 bp, Homo sapiens
  misc_feature: GYAE6OF02H6YVR.23.72.G06.1.454.CMB.1.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
tcagacgcgagtatcacgaccggtgctcgatttagctacgactgcaagggaaagggggcagggagtcagtctcagtcaggacacagcatggacatgagggtccccgctcagctcctggggctctgctactctggctccgaggtgccagatgtgacatccagatgacccagtctccatcctccctgtctgcatctgagagacagatcacatcacttgccggganagtcagancattagcgagacttaagtttaaattggtatcagtacaaggaaacccggaaggaaacgtaccccctaagaccgttaccgtgaacttactagttcgacttacgactacttaccgtagttacgtaaccgaaacgggttcgggtacccaacgttaccgtaaagggttccaggttggacgaggtacggtactcggtgggtaacgtacggtaacgttcgtaccgtacgtcaacgtacttaacgcgaccgtagtccgtacgaccacgtaccgtagtaacgttacgttttacaaccgtttaccttaagttaccgtacgtacgtaaacgtaaccggttaccgtttaacccgtacccgttaaccgggtacccgttaacccgggtaccgggaaccgggttaaccgggaaacggttacggaaccgtttaaccgaaacccgtaaaccgggttaccgtttaccgggtacggtaccttacccgg

SEQ ID NO: 42471 - DNA, 601 bp, Homo sapiens
  misc_feature: GYAE6OF02HXXWP.23.72.G06.1.454.CMB.1.raw
  modified_base (174)..(174): a, c, t, g, unknown or other
  misc_feature (174)..(174): n is a, c, g, or t
  modified_base (284)..(284): a, c, t, g, unknown or other
  misc_feature (284)..(284): n is a, c, g, or t
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtccnccatccctccctgtctgcatctgtaggagacagagtcaccatcacttgccgggcaagtcagagcattagcagctaatttaattggtatcagacaagaaaccagggaaacnccccgtaagcctcctgactctatgctgcactaccagtttcgacgtaaggtcgggtacccagtacgtaaggttacaggtggacaggtggtacgtcggtacgggactaaggttactttccgtaaccgttctaccgaacctactcacgtctaagttcctacgacctacgtagtaagtactttcgaactaacttactactcgtaccaactagtacgttaacaccgttaccccgttacttaccggttttacggaccgtaacgggtaacccaaggtaccgtacgggactacggtaaccaaacggtaaccttggtacgtaacgg

SEQ ID NO: 42472 - DNA, 728 bp, Homo sapiens
  misc_feature: GYAE6OF02F6YF3.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatcgacccagtctccatcctccctgtcctgcctatcgtgtaggacgacagacgtccaccatccacttgccgggacaagtcagagcattagcagtcttaatttaaagttggtattcgacgactaacgaaaaccgaacggggaaacgacccccgtaaaggccttacctacgtaacgttacctattcgtccttacggcctaacttcccgtagtttacgaaccgtaaaggttccgggggttaccccaagtttccgaaacgggtttacgaaggtggtaccgtaagggttacggtaacgttcggtacggggtaacgtaacggttaactttaccgtaacgttccctaccgaacctaacgttcgacgtacacggttacgtacggtactaacccgttagtaaacgtttacgtttcgtaaccttaacctttaacgtaccgttacgttaaccgaacgttaacgtaaacgttacgtaacccgttaaccccgttacgttaccgttttaccggaccggtaaccgggtaccgtaacggtaccgtaggacgttacgtaccgtaaacgacgttcggtaggtacg

SEQ ID NO: 42473 - DNA, 829 bp, Homo sapiens
  misc_feature: GYAE6OF02I6WQO.23.72.G06.1.454.CMB.1.raw
tcagacgcgagtatcacgaccggtgctcgatttagctacgactgcaagggaaagggggcaggagtcagtctcagtcaggacacagcatggacatggacgggtccccgctcagctccgtggggcctcctgctactctggctccggaggtgccagatgtgacatccgagatcgacccagtcctccactcctcctgtctagctatctggagagaacgagacgtaccaccatctacgtcgggccggacaagtcgagagtacctaagttacgactaagtactttaaagtttaagttaggtactacgaacgtacgaaaccggtaaaaccggaacgggtaaacccgtaccccgtaaagtcccgttaccggtacgtaaccttcctattacgacgttcgaccttacgttaccgtacggttacgaaccggttaaacgggttccgggttaccctaacgttaaccggtaaggttactacgggtcgtacggtaggttacggtaacgttcggtaccggggtaattacggtttaccctttacgacctttacccgtaccgtaaacgttcccgtactaacggttaaccctacgggtttccgaaaccttaccgggtaaaccgttagggtaaacttttaccggtttaaccggaacccttttaaacgtttaccctaccggttaaaccgttaacaaaccggtttaaacctaaccggtttaaacccccgtaaccgtttaaccccggttcgttaaccccgggtttcggtaacccgggaaccggttaacgtaaccggtacggttaaccgtaacgaaccgttaaaccgtaacgggttacctggtaccctaccgg

SEQ ID NO: 42474 - DNA, 244 bp, Homo sapiens
  misc_feature: GYAE6OF02FQF52.23.72.G06.1.454.CMB.1.raw
  modified_base (214)..(244): a, c, t, g, unknown or other
  misc_feature (214)..(244): n is a, c, g, or t
tcagacgcgagtatcacgaccggtgctcgatttagctacgactgcaagggaaagggaccacggtcaccgtctcctcagcctccaccaagggcccatcggtcttcccccctggcaccctcctccaagagcacctctgggggcacagcggccctgggctgcctggtcaaaggctacttccatactcgcgtctgagcgggctggcaaggcgcatagnnnnnnnnnnnnnnnnnnnnnnnnnnnnnnn

SEQ ID NO: 42475 - DNA, 648 bp, Homo sapiens
  misc_feature: GYAE6OF02H64N8.23.72.G06.1.454.CMB.1.raw
tcagacgcgagtatcacgaccggtgctcgatttagctacgactgcaagggaaagggggcaggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcacatcacttgccggtcaagtcagagcattagcagtacttaatttaaagttggtatcagtacaagaaaccgaagggtaaaccgtacccgtaagcctaccgtgaactctatcgctacgcactcgtacgtttcgaacgtaaagtcgggtacctagtacgtaagttcgacgttagacgtacggtaggtacttacggtcggaacacggttactttaccgtaccttactacctaccgtacttacagtacgtacgttaacgtactaccgtaacgtaacgtaaagtttacgtttacgtaccgttaaacctttaccgttaacgttacgtaactaaacgtacgtaacgttaacgtaccgtacccttacgtacgttttacggacggtaaccgggtaccaaggtaccgtaggtacgtaacgttaaccgaaaccgtaacgttacggtagtaccg

SEQ ID NO: 42476 - DNA, 545 bp, Homo sapiens
  misc_feature: GYAE6OF02JBUI9.23.72.G06.1.454.CMB.1.raw
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
  modified_base (506)..(506): a, c, t, g, unknown or other
  misc_feature (506)..(506): n is a, c, g, or t
  modified_base (518)..(518): a, c, t, g, unknown or other
  misc_feature (518)..(518): n is a, c, g, or t
  modified_base (520)..(545): a, c, t, g, unknown or other
  misc_feature (520)..(545): n is a, c, g, or t
tcagacgcgagtatcacgaccggtgctcgatttagctacgactgcaagggaaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctagaaaacccgaggaacacagccgtagtattactgtactaggagggcactattacgattattttgacttggttacttctcccggaggacctactctacatggtacgtcgtggggctaaggggaccacggtcaccggttcnccgtcngcctccaccgaacgggccactacggtccttccccgnggacctccctcccacacgctccgaccgtacggtcggggccacgagcccgggacccgtgggcctgtcccgtggaccaaggtaccgttctaccattacccgtcggtcgtacgttcggcggtcgggacttggccgacggngacctgagtacncnnnnnnnnnnnnnnnnnnnnnnnnnn

SEQ ID NO: 42477 - DNA, 723 bp, Homo sapiens
  misc_feature: GYAE6OF02FVW4V.23.72.G06.1.454.CMB.1.raw
  modified_base (105)..(105): a, c, t, g, unknown or other
  misc_feature (105)..(105): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
tcagacgcgagtatcacgaccggtgctcgatttagctacgactgcaagggaaagggggcaggagtcagtctcagtcaggacacagcatggacatgaggtccccgntcagctcctgggctcctgctactctggctccgagtgcagatgtgacatcccagatcgacccagtctccatccctcctgtctgctatctgtaggagacagagtcaccatcacttggcccggganaagtcaaganctaattagcgagtactttaatttaatggtatacgagacaaggtaaacccgaggggtaaacccacccctaaggtccttaccgtgttaactccgtattcgactcgtacctacttaccgttaggtttacgaagtaaacgggtccgggtaaccctagtacgtaacgggttctagggtgtacgtaggtggtactacggtacggatacgtacgttactacgtaccctacgacctacgtacgacgaccttacgttaccgacgtaaaccgaaccgttaacgaaggtttcttttaacggaccccttaaaccgtttacgttaaccgttagtaaccgtaaaccttaacggttaacctttaaacccgacccgtttaaacccccgtttcgtttaacccggtttaccggggtacccgtaaaccggggaaccctttaacggaccggttaaggtaaccgtaacgtaaacccgttaaggtaccggttacggttacccggacc

SEQ ID NO: 42478 - DNA, 664 bp, Homo sapiens
  misc_feature: GYAE6OF02JTA3B.23.72.G06.1.454.CMB.1.raw
  modified_base (296)..(296): a, c, t, g, unknown or other
  misc_feature (296)..(296): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
tcagacgcgagtatcacgaccggtgctcgatttagctacgactgcaagggaaagggggcaggagtcagtctcagtcaggacacagcatggacatgacgggtccccgctcagctcctggggctcctgctactctggcctccggaggtgccagatgtgacatccagatcgacccagttctcactccgtacctgtctcgcactcgtgtaggacgaacacgagtccaacctactcctaacggttccggccgggactaagtcagagctaagttacgcagtacttaatttaacgtgtatcanacgtaacgaaacgtaacgggaacctacccgtagtcctaccgttagacttacgtacgtcgtagtccgacttacgttaccgttacgttaacggtacgtaaacgggttcggtaccgtaacgtacggttaacggttcgaggtaccgtacggnggttaccggtaagtccgtagtacgtacgtttntaaccgtctaccggtaccctaaggcttacgacgttcgtaaccgctacgtctaacgtgtagttnttaacgngttaactctaagtcgtacaacttaagtccgttaaacaccgttaccgttgtaaccggttacggaacggtaccgaggttaacacggtacgcttaacgaacctaacggtgttacggactac

SEQ ID NO: 42479 - DNA, 675 bp, Homo sapiens
  misc_feature: GYAE6OF02IQXM0.23.72.G06.1.454.CMB.1.raw
  modified_base (107)..(107): a, c, t, g, unknown or other
  misc_feature (107)..(107): n is a, c, g, or t
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
  modified_base (533)..(533): a, c, t, g, unknown or other
  misc_feature (533)..(533): n is a, c, g, or t
  modified_base (619)..(619): a, c, t, g, unknown or other
  misc_feature (619)..(619): n is a, c, g, or t
tcagacgcgagtatcacgaccggtgctcgatttagctacgactgcaagggaaagggggcaggagtcagtctcagtcaggacacagcatggacatggacggtccccgntcagctctgggggctccgtgctactcgtggtcctaccggtggcgacgtaagtgttcgganacacgtaccagtacgacggacctagttccacctcctcccttccggtcgttctaactcacggtcgttggaagacgngaagtccaacnctaggtctcggtcggccggaagacctagacgaacncttaagccgntacgttagttttaaataaggtttnaccagcggaacgaaaacttaaacggggtacggtaaccaccggttancgttacggattacncttgaccnggtcgcttaaggccgtttaagtccaagggacgtcgaccttatacggtaaggtgtacgctagggtagtaccgggntaaacccggggnggtaactctttaancgtctcaagtacgntacagcccttaagntacccgattaaccgngttaactacctttgaaactcgtactcgtaagactagaactttacgcccgttaagtacccgttagttcccggaaacggcgggtaacnccggttaacgagggacctaacgttaacgaaccggtgttaaggtccggttcgaacgg

SEQ ID NO: 42480 - DNA, 474 bp, Homo sapiens
  misc_feature: GYAE6OF01DGV46.9.9.A09.1.454.CMB.1.raw
  modified_base (462)..(462): a, c, t, g, unknown or other
  misc_feature (462)..(462): n is a, c, g, or t
  modified_base (466)..(474): a, c, t, g, unknown or other
  misc_feature (466)..(474): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaacccctcatctatggtaatagtaatcggccctcaggggtcctgaccgattctctggctccaagtctggcacctcagcctccctggccatcactggcttcaggctgaggatgagctgattatactgccactcctatgacagcagcctgagaagtgtggtattcgggcggagggaccaagctgaccgtctaggtcagcccaaggctgccccctggtcactctcgttcccaccctcctcagtacgtatcactgagcggctggcaggcnatgnnnnnnnnn

SEQ ID NO: 42481 - DNA, 480 bp, Homo sapiens
  misc_feature: GYAE6OF01C2NIH.9.9.A09.1.454.CMB.1.raw
  modified_base (424)..(424): a, c, t, g, unknown or other
  misc_feature (424)..(424): n is a, c, g, or t
  modified_base (467)..(467): a, c, t, g, unknown or other
  misc_feature (467)..(467): n is a, c, g, or t
  modified_base (471)..(480): a, c, t, g, unknown or other
  misc_feature (471)..(480): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactggcttcaggctgaggatgaggctgattattactgccactccatgacagcagcctgagaagtgtggtattcgggcggagggaccaagctgaccgtctaggtcagccaaggctcgcccctggtcactctcgttcccnccctcctcacgtactactcactgacgcgggctggcaaggcganatgnnnnnnnnnn

SEQ ID NO: 42482 - DNA, 487 bp, Homo sapiens
  misc_feature: GYAE6OF01C6735.9.9.A09.1.454.CMB.1.raw
  modified_base (349)..(349): a, c, t, g, unknown or other
  misc_feature (349)..(349): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (478)..(487): a, c, t, g, unknown or other
  misc_feature (478)..(487): n is a, c, g, or t
tcagtgatacgtctcacgaccggtgctcgatttagcgagacgcgcaggggtcctgggcccgagtctgtgtctgacgcagccgcccgtcagtgtctcgggccccagggtcagagggtcaccatcgtcctgcactgggagcagctccaacatcgggaatcggctatgttgtacactggtaccagcagcttccaggaacagtccccaaaccctcatctatggtaatagtaatcggccctcgaggggtccctgaccgattctctggctccaagtctggcactcagcctcctggtcatcactggcttcaggctgaggatgagctgattatctgccatcatgacagctagctganagtcgtggtatcggcggaggaccaagctgaccgtctaggtcagccaaggctcgccccctggtcnctctcgttcccgcctacctcagtaccgtatccacgtgagccgggntcgggacaaggcgnacgagnnnnnnnnnn

SEQ ID NO: 42483 - DNA, 481 bp, Homo sapiens
  misc_feature: GYAE6OF01BKE2F.9.9.A09.1.454.CMB.1.raw
  modified_base (466)..(466): a, c, t, g, unknown or other
  misc_feature (466)..(466): n is a, c, g, or t
  modified_base (471)..(473): a, c, t, g, unknown or other
  misc_feature (471)..(473): n is a, c, g, or t
  modified_base (475)..(481): a, c, t, g, unknown or other
  misc_feature (475)..(481): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactgggcttcaggctgaggatgaggctgattattactgccactcctatgacagcagcctgagagtgtggtattcggcggaggaccaagctgaccgtctaggtcagcccaaggctcgcccctggtccactctcgttcccgtcctcctcagtacgtactcactgacgcgggctggcaggcgnagtgnnngnnnnnnn

SEQ ID NO: 42484 - DNA, 529 bp, Homo sapiens
  misc_feature: GYAE6OF01AST1J.9.9.A09.1.454.CMB.1.raw
  modified_base (519)..(520): a, c, t, g, unknown or other
  misc_feature (519)..(520): n is a, c, g, or t
  modified_base (523)..(529): a, c, t, g, unknown or other
  misc_feature (523)..(529): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatcggccctcacggggtccctgaccgattctctggctccaagtctggcacctcacgccctcctggccatcacgtgggcttcgaggctgaggatgaggctgatttattactgcctactcctatcgacagcagcctagaagagttgtggtagttcgggacgggaggaccaagctcgaccgtccgtaggtcacgcccaaggcctccgccccgtcgtccacttctccgtccccaccctcctccgacgtaccgtactccgacgtcggacggccgggtcgtcgggacgacgggccgacagtagcnncgnnnnnnn

SEQ ID NO: 42485 - DNA, 533 bp, Homo sapiens
  misc_feature: GYAE6OF01A0AV7.9.9.A09.1.454.CMB.1.raw
  modified_base (334)..(334): a, c, t, g, unknown or other
  misc_feature (334)..(334): n is a, c, g, or t
  modified_base (524)..(533): a, c, t, g, unknown or other
  misc_feature (524)..(533): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatccggccctcgacggggtccctgaccgattctctggctccaagtctggcacctcacgccctccctggccatcacgtgggcttcgaggctggaggatgaggctgatttattacngccactcctatgacagcagcctgagtagtggtgtagttcgggacgggacgggaccaggctcgaccgtccgtaggtcacgcccgaaggccgtccgcccccgtcggtccactccttccgttccccacccttcttccgacgtaccgtactctacgtcgacggcgggcgtcgggacgaacggcgacgagtacgnnnnnnnnnn

SEQ ID NO: 42486 - DNA, 483 bp, Homo sapiens
  misc_feature: GYAE6OF01EX4D1.9.9.A09.1.454.CMB.1.raw
  modified_base (470)..(470): a, c, t, g, unknown or other
  misc_feature (470)..(470): n is a, c, g, or t
  modified_base (475)..(483): a, c, t, g, unknown or other
  misc_feature (475)..(483): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctagacccgtctaggtcagcccaaggctcgccccctggtcactctcgtcccaccctcctcagtacgtatcactgagcgggctggcaggcgnatcgnnnnnnnnn

SEQ ID NO: 42487 - DNA, 486 bp, Homo sapiens
  misc_feature: GYAE6OF01AIEHY.9.9.A09.1.454.CMB.1.raw
  modified_base (476)..(478): a, c, t, g, unknown or other
  misc_feature (476)..(478): n is a, c, g, or t
  modified_base (480)..(486): a, c, t, g, unknown or other
  misc_feature (480)..(486): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagagtgtggtattcgggcggaggacagctgaccgtctagcagccagctcgcccctcggtcacgtctcgttcccgccctcctcgacgtaccgtactccactcggagccgggctggccgaaggcgcagtgnnngnnnnnnn

SEQ ID NO: 42488 - DNA, 489 bp, Homo sapiens
  misc_feature: GYAE6OF01CWCEP.9.9.A09.1.454.CMB.1.raw
  modified_base (325)..(325): a, c, t, g, unknown or other
  misc_feature (325)..(325): n is a, c, g, or t
  modified_base (474)..(474): a, c, t, g, unknown or other
  misc_feature (474)..(474): n is a, c, g, or t
  modified_base (479)..(480): a, c, t, g, unknown or other
  misc_feature (479)..(480): n is a, c, g, or t
  modified_base (482)..(489): a, c, t, g, unknown or other
  misc_feature (482)..(489): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctcatctatggtaatagtaatcggccctcgacggggtccctgaccgattctctggctccaagtctggcacctcacgcctcctgccatcacgtggcttcgaggctgagatgagctgattatacngcctactcctatgacagcagcctagacgtaagtggtggtatcgggcggaggacagctcgaccgtctaggtcacgccagctcgcccctggccactctcgttcccgccctcctcacgtcgtatctacgtgacggcggctggacgaaggcanagtgnngnnnnnnnn

SEQ ID NO: 42489 - DNA, 493 bp, Homo sapiens
  misc_feature: GYAE6OF01DP58X.9.9.A09.1.454.CMB.1.raw
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
  modified_base (484)..(484): a, c, t, g, unknown or other
  misc_feature (484)..(484): n is a, c, g, or t
  modified_base (487)..(493): a, c, t, g, unknown or other
  misc_feature (487)..(493): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttcaggaacagtccccaaaccctnatctatggtaatagtaatcggccctcgaggggtccctggaccgattctctggctccaagtctggcacctcacgcctcctggccatcacgtgggcttcaggctgaggatgaggctgattatacngccactcatgacagcagcctagagagtgtgtagtcgggcggaggacaagctcgaccgtctaggtcacgccaaggctcgcccctcgtccactctcgtcccgccctcctcagtacgtactcacgtcgacgcgggcgtggaccacgggcgacgagtagcancgnnnnnnn

SEQ ID NO: 42490 - DNA, 482 bp, Homo sapiens
  misc_feature: GYAE6OF01ANBUG.9.9.A09.1.454.CMB.1.raw
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (475)..(482): a, c, t, g, unknown or other
  misc_feature (475)..(482): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactgggcttcaggctgaggatgaggctgattattactgccactcctatgacagcagcctgagagtgtggtattcggcggaggaccaagctgaccgtctaggtcagcccaaggctcgcccctcggtcactctcgtcccaccctcctcacgtcgtatcactgagcgggctggcaagggcganagtagcngnnnnnnnn

SEQ ID NO: 42491 - DNA, 501 bp, Homo sapiens
  misc_feature: GYAE6OF01BQ2PK.9.9.A09.1.454.CMB.1.raw
  modified_base (492)..(501): a, c, t, g, unknown or other
  misc_feature (492)..(501): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcacgccctccctggccatcactgggcttcaggctgaggatgaggctgattattactgcctactcctatgacagcagcctgagaagtgtggtattcgggcggagggaccaagctgaccgtctaggtcacgcccaagcctcgcccctcgtccactctcgttcccaccctcctcacgtaccgtactcactcgacggccgggcgtcggacgacggcgacagtagnnnnnnnnnn

SEQ ID NO: 42492 - DNA, 502 bp, Homo sapiens
  misc_feature: GYAE6OF01CHVRL.9.9.A09.1.454.CMB.1.raw
  modified_base (340)..(340): a, c, t, g, unknown or other
  misc_feature (340)..(340): n is a, c, g, or t
  modified_base (493)..(493): a, c, t, g, unknown or other
  misc_feature (493)..(493): n is a, c, g, or t
  modified_base (495)..(502): a, c, t, g, unknown or other
  misc_feature (495)..(502): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactgggcttcaggctgaggatgagctgattattactgcagctcatatacaaccngcgacactctgttgttcggcggtagggactgaactgaccgtcctaggtcacgacccaaggctccgccccctcggtccaccttctcgttccccaccctccctcacgtaccgtactcctactcgaggccgggctcgggcgaacggcgcagtacgncnnnnnnnn

SEQ ID NO: 42493 - DNA, 490 bp, Homo sapiens
  misc_feature: GYAE6OF01D62UM.9.9.A09.1.454.CMB.1.raw
  modified_base (476)..(476): a, c, t, g, unknown or other
  misc_feature (476)..(476): n is a, c, g, or t
  modified_base (481)..(490): a, c, t, g, unknown or other
  misc_feature (481)..(490): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtcccccaaaaccctcatctatggtaatagtaatcggccctcaggggtccctgaccgattctctggctccaagtctggcacctcagcctccctggccatcactgggcttcaggctgaggatgagctgattatactgccactcctatgacagcagcctgagagtgtggtattcgggcggaggaccaagctgaccgtctaggtcagcccaaggctccgcccccgtcgtccactctcgttcccgccctcctcacgtacgtatcacgtgacgcgggctcggacacgggcgnagtgnnnnnnnnnn

SEQ ID NO: 42494 - DNA, 487 bp, Homo sapiens
  misc_feature: GYAE6OF01CAVP6.9.9.A09.1.454.CMB.1.raw
  modified_base (478)..(487): a, c, t, g, unknown or other
  misc_feature (478)..(487): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcgggcggagggaccaagctgaccgtcctaggtcagcccaagctcgccccctggtcactctcgttcccaccctcctcacgtacgttcacgtgagccgggctcggcaaggcgcataggnnnnnnnnnn

SEQ ID NO: 42495 - DNA, 580 bp, Homo sapiens
  misc_feature: GYAE6OF01A5KYK.9.9.A09.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttcaggacagtcccaaaccctnatctatggtaatagtaatcggccctcgaggggtccctgaccgattcnctggctcaagtctggcactcagcctccnggccatccgacgtcgggcttcaggtctggaggactggacgctaggtactttatacgtcgacctactcctaatcgacagcagtcctagagtaacgtgtcgttagttccgggacgggtacggaaccgaagtccgtacgaccgtccgtaaggtccgacgtacccgaaggtccgtccggcccccgttacggtacctaccgtccgttaccgttccccacccttcgtaccgaacgtacgtactcgaccgtaggacggtcggtactcggaccgtaagggccgatagacgcgtcngtcgancgtanctgtacg

SEQ ID NO: 42496 - DNA, 478 bp, Homo sapiens
  misc_feature: GYAE6OF01AO8I1.9.9.A09.1.454.CMB.1.raw
  modified_base (466)..(466): a, c, t, g, unknown or other
  misc_feature (466)..(466): n is a, c, g, or t
  modified_base (470)..(478): a, c, t, g, unknown or other
  misc_feature (470)..(478): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagagtgtggtattcgggcggaggacaagctgaccgtctaggtcagcccaaggcctcgccccctggtccactctcgtcccacctcctcagtacgtactcactgacgcggctggcaggcnatgnnnnnnnnn

SEQ ID NO: 42497 - DNA, 511 bp, Homo sapiens
  misc_feature: GYAE6OF01CLGAZ.9.9.A09.1.454.CMB.1.raw
  modified_base (501)..(501): a, c, t, g, unknown or other
  misc_feature (501)..(501): n is a, c, g, or t
  modified_base (505)..(511): a, c, t, g, unknown or other
  misc_feature (505)..(511): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctcaagtctggcacctcacgcctcctggccatccactgggccttcaggtctggaggatggaggctgtattatactgaccactcctatcgacagcagcctagagaagtggtagtatcggcggaggaccagctcgtaccgtcgtaggcacgaccaggctcgcccctcgtccactcttcgtcccctacctcctacagtaccgtatccgtactgacggtccgggatcgggcgaacggccgtacagtacggnagcnnnnnnn

SEQ ID NO: 42498 - DNA, 493 bp, Homo sapiens
  misc_feature: GYAE6OF01BO80V.9.9.A09.1.454.CMB.1.raw
  modified_base (480)..(480): a, c, t, g, unknown or other
  misc_feature (480)..(480): n is a, c, g, or t
  modified_base (484)..(493): a, c, t, g, unknown or other
  misc_feature (484)..(493): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaacccctcatctatggtaatagtaatcggccctcaggggtccctgaccgattctctggctccaagtctggcacctcagccctccctggccatcactgggcttcaggctgaggatgaggctgattattactgccactcctatgacagcagcctgagaagtgtggtattcgggcggagggaccaagctgaccgtctaggtcagccaaggcctcgccccctcggtccactcctcgttcccaccctcctacacgtacgtactcactgacgcgggctggcgaggcganatgnnnnnnnnnn

SEQ ID NO: 42499 - DNA, 509 bp, Homo sapiens
  misc_feature: GYAE6OF01DC6W0.9.9.A09.1.454.CMB.1.raw
  modified_base (501)..(509): a, c, t, g, unknown or other
  misc_feature (501)..(509): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtacccccaaaccctcatctatggtaatagtaatcggccctcgacggggtccctgaccgattctctgctccaagtctggcactcacgcctcctggccatcacgtggccttcgagctgaggatgaggctgtattacttactcgccacttcctatgacagcagctagagagtgtgtatcgggcgaggacagctagaccgtctagcacgccaggctccgccccgtcggccaccttctccgttccccaccctcctacgacgtacgtatccgactcggacggaccggtcgtcggaccgaaggcgtacaagtgacnnnnnnnnn

SEQ ID NO: 42500 - DNA, 492 bp, Homo sapiens
  misc_feature: GYAE6OF01BHA4R.9.9.A09.1.454.CMB.1.raw
  modified_base (324)..(324): a, c, t, g, unknown or other
  misc_feature (324)..(324): n is a, c, g, or t
  modified_base (483)..(492): a, c, t, g, unknown or other
  misc_feature (483)..(492): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcgacggggtccctgaccgattctctggctccaagtctggcacctcagcctcctggccatcactgggcttcaggctgagatgaggctgattattacngaccactcctaatgacagcagcctgagaagtgtggtattcgggcggaggacaagctgaccgtctaggtcacgcccaaggcctacgcccctggtccactctcgtccccaccctcctcacgtactactcacgtgacgcggctggcgaacggcacagtacgnnnnnnnnnn

SEQ ID NO: 42501 - DNA, 523 bp, Homo sapiens
  misc_feature: GYAE6OF01EXU45.9.9.A09.1.454.CMB.1.raw
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (510)..(511): a, c, t, g, unknown or other
  misc_feature (510)..(511): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (520)..(521): a, c, t, g, unknown or other
  misc_feature (520)..(521): n is a, c, g, or t
tcagtgatacgtctcacgaccggtgctcgattttagcgagacgcgcagggtcctgggtcccggagtctgtggctgacgcagccgccctcagtgtctggggccccaggggcagagggtccacccatctcctgcactgggaggcagcgtccaagatcgggaatccgctatgttgtacactggtaccagcgagcttccaggaacagtcccccaaaacccctcatctatggtaatagtaatcggccctcaggggtccctgaccgatttactctggctccaagtctggcacctcacgcctaccctcggaccatcacctgggctttcaggctcggaggatggacgctggtattattactcgccactcctancgaacngcaagcctgacgagtgtggtattcggcggaggaccaaggctgacgtcaggtcagaccagctcgcccctcggtcactctgttcccgccctctcagacttatcgcttcggagcgggctgggaccaaggccgagagtacgcnncgancnngnncg

SEQ ID NO: 42502 - DNA, 556 bp, Homo sapiens
  misc_feature: GYAE6OF01C1ZU8.9.9.A09.1.454.CMB.1.raw
  modified_base (377)..(377): a, c, t, g, unknown or other
  misc_feature (377)..(377): n is a, c, g, or t
  modified_base (548)..(550): a, c, t, g, unknown or other
  misc_feature (548)..(550): n is a, c, g, or t
  modified_base (552)..(556): a, c, t, g, unknown or other
  misc_feature (552)..(556): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacatcgggaatcgctatgttgtacactggtaccagcagcttccaggaacacgtaccccaaaccctcatctatggtaaatagtaatcggccctcgaggggtccctgaccgattctctggctccaagtctggccacctcacgcctcctggccatcactggcttcaggctagagatgaggctagattaatactgacctacttcctatgacagcagcctagagaagtgtaggtattcggngggaaggacaagctgaacccgtctaggacaacgccccgaaggccgtaccgcccccgtcggtaccacgttccgtcgtttcccccgaccccttccctacaacggtaccgttaactaccacgtcggacgggaccggggtcgcgggacgaaaggggtcccgacaacgtaaaggcnnnannnnn

SEQ ID NO: 42503 - DNA, 671 bp, Homo sapiens
  misc_feature: GYAE6OF01AXFG4.9.9.A09.1.454.CMB.1.raw
  modified_base (658)..(658): a, c, t, g, unknown or other
  misc_feature (658)..(658): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(670): a, c, t, g, unknown or other
  misc_feature (669)..(670): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatccggccctcgacggggtccctgaccgtattctctggctaccaagtctggccacctcacgccctccctggccatccacgtgggcttcgaggtctggaggatggaggctgatttattactgccctactcctatcgactagccagtcctagaggtaagtggttacgggtattcgggacgggacgggaacccaaggtccgtacggacccgttacgtacgggtaccaacggtaccccgaacgggtcccgtacccggtccccccgttcggtaccctaacccgttcccgttaccccgtttaccccctaaccccccgttccccgttaccggtaaccgttaacccgttaaccttacccgtaccgtacgggtaaccggggtcccggggtaccgttaccggggaacccggtaaacggggtcccgtacggtaacgttacggacacgancgacgancngnng

SEQ ID NO: 42504 - DNA, 492 bp, Homo sapiens
  misc_feature: GYAE6OF01BOGMN.9.9.A09.1.454.CMB.1.raw
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (486)..(492): a, c, t, g, unknown or other
  misc_feature (486)..(492): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaacccctcatctatggtaatagtaatcggccctcaggggtccctgaccgattctctggctccaagtctggcacctcagccctccctggccatcactgggcttcaggctgaggatgaggctgattatactgccactcctatgacagcagcctgagagtgtggtattcgggcggagggccaagctgaccgtcgtaggtcagcccaaggcctcgcccctcggtcactctcgttcccaccctcctcacgtacgtactcactggcgcgggctggcaagggccgnagtgcngcnnnnnnn

SEQ ID NO: 42505 - DNA, 579 bp, Homo sapiens
  misc_feature: GYAE6OF01DHB5K.9.9.A09.1.454.CMB.1.raw
  modified_base (330)..(330): a, c, t, g, unknown or other
  misc_feature (330)..(330): n is a, c, g, or t
  modified_base (571)..(579): a, c, t, g, unknown or other
  misc_feature (571)..(579): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaacccctcatctatggtaatagtaatcggccctcaggggtccctgaccgattctctggcctccaagtctggccacctcacgcctccctggccatcacgtggcttcgagctggagatgagctgtattatacngcctactcctatgacagcacgcctaggagtaagttggtaggtacgttcggggacgggaacgggtaaccaaggtccgtacggtacccgtccgttaacgggtaccgacggaccccgaacgggcctccggcccccgtcggtcctacctcctccgttcccccacccttcctaccgacgtaccgttactcccgtacgtcggacggtccgggtcgtacggggacaacgggaccgtacgagtacgcgnnnnnnnnn

SEQ ID NO: 42506 - DNA, 504 bp, Homo sapiens
  misc_feature: GYAE6OF01CVW7M.9.9.A09.1.454.CMB.1.raw
  modified_base (369)..(369): a, c, t, g, unknown or other
  misc_feature (369)..(369): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (497)..(504): a, c, t, g, unknown or other
  misc_feature (497)..(504): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcacggggtccctgaccgattctctggctccaagtctggcacctcacgcctccctggcccatcacgtgggcttcaggctgaggatgaggctgattatactgccactcctatcgacagcagcctagagaagtgtgtagtcggnggaggaccaagcgtagaccgtcgtaggtcacgcccaagctccggcccctcggtctactcctcgtcccaccctcctcacgacgtntcactgacgccgggctcgggacgaacggcganagtaagntacgnnnnnnnn

SEQ ID NO: 42507 - DNA, 496 bp, Homo sapiens
  misc_feature: GYAE6OF01B4F4C.9.9.A09.1.454.CMB.1.raw
  modified_base (344)..(344): a, c, t, g, unknown or other
  misc_feature (344)..(344): n is a, c, g, or t
  modified_base (487)..(496): a, c, t, g, unknown or other
  misc_feature (487)..(496): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaacccctcatctatggtaaatagtaatcggccctcgacggggtccctgaccgattctctggctccaagtctggcacctcagcctccctggcccatcactgggcttcaggctgaggatgagctgattattactgccactcctatgacngcagcctagagtaagtgtaggtattcgggcgggagggacagcgtgaccgtcgtagtcacgcccaagctcgcccctcggcactctcgttcccgcctcctcagtactatcactgacggcggcgtcggacgaaggcgacagtacgnnnnnnnnnn

SEQ ID NO: 42508 - DNA, 599 bp, Homo sapiens
  misc_feature: GYAE6OF01DNNJY.9.9.A09.1.454.CMB.1.raw
  modified_base (590)..(599): a, c, t, g, unknown or other
  misc_feature (590)..(599): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatccggccctcgacgggtccctgaccgtattctctggctccgaagtctggccacctcacgccctcctgccatcacgtggcttcgaggctagaggatgaggctgtattatactcgacctactacctatcgaactagccagccgtaggaagtaagttggtggttacgtcgggacgggaacggaccaagccgtacggaccgtccgtaggtactacgacccgaacgggtcctcccggtccccccgtcggtccctaccgttcccgttccgttacccccgtcccccttcctacccgaacgttacccgttactacctaccggtcggaacgggcccgggttacgaccgggtacgaaccgggaccgacgtaagtacggnnnnnnnnnn

SEQ ID NO: 42509 - DNA, 477 bp, Homo sapiens
  misc_feature: GYAE6OF01BYKKJ.9.9.A09.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(477): a, c, t, g, unknown or other
  misc_feature (470)..(477): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctnatctataggtaatagtaatccggccctcgacggggtcccctgaccgattctctggctccaagtctggcacctcagccctcctggcccatcactgggcttcaggctgaggntgaggctgattatactgccactcctangacngcagcctgagagtgtgtagttcgggnggaggacagctagaccgtctagtcacgccaggcctcgcccctgtccactctcgttcccncctcncagactatcactgacgcggntcggacaggcnangnnnnnnnn

SEQ ID NO: 42510 - DNA, 572 bp, Homo sapiens
  misc_feature: GYAE6OF01B90M4.9.9.A09.1.454.CMB.1.raw
  modified_base (206)..(206): a, c, t, g, unknown or other
  misc_feature (206)..(206): n is a, c, g, or t
  modified_base (320)..(320): a, c, t, g, unknown or other
  misc_feature (320)..(320): n is a, c, g, or t
  modified_base (563)..(563): a, c, t, g, unknown or other
  misc_feature (563)..(563): n is a, c, g, or t
  modified_base (565)..(572): a, c, t, g, unknown or other
  misc_feature (565)..(572): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcacgtgggagcagctccaacatcgggaatcgctatgttgtacactggtaccagcagcttccaggaaccagtcccccaaaccctnatctatggtaatagtaatccggccctgaggggtccctgaccgattctcgtggcctaccaagtctggcacctcacgccctccgtggccagtcacgtggccttcgaggctgaggtntggagtctagtattactactcgacctacttcagtcgaacgacgcaacgtctaggaagtaaggttggttacgggtagttccgggacgggtaacggaccgaagcgtacggtaccgtccgtaggtcgaacgccgaacggccgtaccgccccgtcgtcctaccgtctcccgttccccacccgtcctaccgtaccgtacctacgtactacgtacgacggcgggtcgtcggacgacggtcgagactgcngnnnnnnnn

SEQ ID NO: 42511 - DNA, 729 bp, Homo sapiens
  misc_feature: GYAE6OF01AEVQZ.9.9.A09.1.454.CMB.1.raw
  modified_base (260)..(260): a, c, t, g, unknown or other
  misc_feature (260)..(260): n is a, c, g, or t
  modified_base (718)..(718): a, c, t, g, unknown or other
  misc_feature (718)..(718): n is a, c, g, or t
  modified_base (725)..(725): a, c, t, g, unknown or other
  misc_feature (725)..(725): n is a, c, g, or t
tcagtgatacgtctcacgaccggtgctcgatttagcgagacgcgcagggtcctgggcccagtctgtgctgacgcagcccgccctcagtgtcgtggggccccagggcagagggtccaccatctcctgcacgtgggagcagctccaacagtcgggaatcgctatgttgtacactggtaccagcagcttccgaggaaccacgtacccccaaaccctcatctataggtaatagtaactccgccctcgacgggtccctgaccgtnttctcgtcggctccgaagtcgtcgcctaccctcgaccgtccccttcccgtcggcccctacgtaccgtaccggttcgggtccctttaccgacgggtccgttaggaggtacgttaggacggtcttaggttactttacgttaccgtcgaccctaacttccttaagtcgaactcgacgtaacgtcgtaggaagtacggttacggttggttacggtcgggacggggtaccgggtaacctaacggtccgtaccgtacccgggttacgtacggtaccaacccggtaacccgaccgggtacccgtcccggtacccccgttcgtccctacccgtttcccgttaccccgttcccccgtcccgtacccgtacgtaccgttaacgttactaccgtacggccggaccgggttcggaccggtacgggtaccgaaccggggtccctacggtacggtacgcctcgagtccgagntacgcgntacg

SEQ ID NO: 42512 - DNA, 517 bp, Homo sapiens
  misc_feature: GYAE6OF01ERYSB.9.9.A09.1.454.CMB.1.raw
  modified_base (206)..(206): a, c, t, g, unknown or other
  misc_feature (206)..(206): n is a, c, g, or t
  modified_base (349)..(349): a, c, t, g, unknown or other
  misc_feature (349)..(349): n is a, c, g, or t
  modified_base (445)..(445): a, c, t, g, unknown or other
  misc_feature (445)..(445): n is a, c, g, or t
  modified_base (509)..(509): a, c, t, g, unknown or other
  misc_feature (509)..(509): n is a, c, g, or t
  modified_base (512)..(517): a, c, t, g, unknown or other
  misc_feature (512)..(517): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaaccctnatctatggtaatagtaatccggccctcgacggggtccctgaccgtattctctggctccaagtctggcacctcagcctcctggccatcactgggcttcgaggctggaggatgaggctgtattattactgcctactcctatgacngcagcctgagagtggtggtatcgggcggaggaccaagctgaccgtcgtaggtcagcccgaaggcctccgccccctcggtccactcctcgttccccnccctcctccacgtacgtactcacgtcggacggccgggcgtcggaccgacgggcgactagtgcangcnnnnnn

SEQ ID NO: 42513 - DNA, 502 bp, Homo sapiens
  misc_feature: GYAE6OF01A0PD2.9.9.A09.1.454.CMB.1.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (494)..(502): a, c, t, g, unknown or other
  misc_feature (494)..(502): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaaaagtccccaaacccctnatctatggtaatagtaatcggccctcaggggtccctgaccgattctctggctccaagtctggcacctnacgcctccctggcccatcactgggcttcaggctgaggatgaggctgattatactgcctactcctatgacagcagcctgagagtgtaggtattcgggcggacgggaccaagctcgaccgtcctacggtcaggcccaaggcctacgccccctcgtcactttctcgttccccgccctcctctagaccgtatcactgagcgggtcnggacagggcgacatagnannnnnnnnn

SEQ ID NO: 42514 - DNA, 499 bp, Homo sapiens
  misc_feature: GYAE6OF01AYQEL.9.9.A09.1.454.CMB.1.raw
  modified_base (252)..(252): a, c, t, g, unknown or other
  misc_feature (252)..(252): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (469)..(469): a, c, t, g, unknown or other
  misc_feature (469)..(469): n is a, c, g, or t
  modified_base (487)..(488): a, c, t, g, unknown or other
  misc_feature (487)..(488): n is a, c, g, or t
  modified_base (493)..(493): a, c, t, g, unknown or other
  misc_feature (493)..(493): n is a, c, g, or t
  modified_base (495)..(499): a, c, t, g, unknown or other
  misc_feature (495)..(499): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttcaggaacacgtccccaaaccctcatctatggtaatagtaatcggccctcgaggggtcccctgaccgtattcnctggctcaagtctggcacctcacgcctcctggccatcacgtggcttcgaggctgaggntgagctgtattntactcgcctactcctatgacagcacgcctagagaagtgtggtagtcgggcgggacggacagcgtcgacgtcgagtcacgacccagcctcgtcccctgtcctactctccgtcccaccctcctcacgtactctcacgtgacgcggtcgnggacgacggcgacagtgnncgtcncnnnnn

SEQ ID NO: 42515 - DNA, 528 bp, Homo sapiens
  misc_feature: GYAE6OF01D200T.9.9.A09.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (518)..(519): a, c, t, g, unknown or other
  misc_feature (518)..(519): n is a, c, g, or t
  modified_base (521)..(528): a, c, t, g, unknown or other
  misc_feature (521)..(528): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtcccccaaaccctnatctatggtaatagtaatccggccctcgacggggtccctgaccgattctctggctccaagtctggccacctcacgccctccctggcccatccacgtgggccttcgaggctggaggntggaggtctgtatttatactcgccactcctangacagcagctagagtagtggtggtagttcgggacggagggaccaggctcggaccgtctaggtcacgcccgacgcctccgcccccgtcgtcctacctctccgtccccnccctcctcacgtaccgtatccacgtcggacggcggtcgcggacgacggtcganatagnngnnnnnnnn

SEQ ID NO: 42516 - DNA, 747 bp, Homo sapiens
  misc_feature: GYAE6OF01CTHBG.9.9.A09.1.454.CMB.1.raw
  modified_base (731)..(731): a, c, t, g, unknown or other
  misc_feature (731)..(731): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
  modified_base (745)..(745): a, c, t, g, unknown or other
  misc_feature (745)..(745): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctataggtaatagtaatcggccctcgacggggtccctgaccgattctctggctccaagtctggccacctcacgccctccctcggccatcacgtcgggtccttcgaggcctggaggtactggaggtctagtaattacgttaacctcgtaccctactaccgttaagtcgaactacggacgaacggtccgttaaggaagtaaaggttggttacgggttacggtttaccggggacggggtaacggggaacccgtaaacggtccggttacggaaccccggttacccggttaacgggttaccgaacccggtaccccgaaccgggtcccgtaccccggtcccccccgttacccgggttaccccgtaacccgttccccgtttcccgtttaccccccgtaaccccccgtttccccttacccgtaaaccggttaccgttaaccttacccgtaaccgttcgggtaaccggggacccgggtcccggttaccgggtaaccggaaccgggtaccggtacccggtaacgttaacggacgngacgtcacancngngc

SEQ ID NO: 42517 - DNA, 529 bp, Homo sapiens
  misc_feature: GYAE6OF01DTWQT.9.9.A09.1.454.CMB.1.raw
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (521)..(521): a, c, t, g, unknown or other
  misc_feature (521)..(521): n is a, c, g, or t
  modified_base (524)..(529): a, c, t, g, unknown or other
  misc_feature (524)..(529): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatccggccctcgacggggtccctgaccgtattctctggcctccgaagtctggccacctcacgcctcccgtgccatcacgtgggcttcgaggctggaggtntgaggctgtattacttactcgcctactcctatgacngcagctgagagtgtggtagtcgggaggacggacagcgtgaccgtcgtagcgacgccgagcctccgccccgtcgtcctacgttccgtaccgttccccgccctccgtacgtacgtacgtactcgacgtcggacggccgggctcggacgaacggcgtagaatgactgncgnnnnnn

SEQ ID NO: 42518 - DNA, 519 bp, Homo sapiens
  misc_feature: GYAE6OF01EAAHG.9.9.A09.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
  modified_base (510)..(519): a, c, t, g, unknown or other
  misc_feature (510)..(519): n is a, c, g, or t
tcagtgatacgtctcacgaccggtgctcgatttagcgagacgcgcagggtcctgggcccagtctgtgctgacgcagccgccctcagtgtctgggccccagggcagaggtcaccatctcctgcactgggagcagctccaacatcgggaatcgctatgttgtacactggtaccagcagcttccaggaacacgtcccccaaacccctnatctatggtaatagtaatccggccctcgacggggtccctgaccgtattctctggcctccgaagtctcggccaacctcacgcctcccnggccatcacgtggcttcgagctgagntgagctagattatactcgcctactctatcgacagcagcctgaagagtgtggtagtcggcggaggacaagcgtagaccgtcgtacgtcacgccgaagcctccgccccgtcgtcctctccgtccgtcccgtccctccncgacgtactacncgtactcggacggccgggtcgtacggacgaacggtcganatcgnnnnnnnnnn

SEQ ID NO: 42519 - DNA, 658 bp, Homo sapiens
  misc_feature: GYAE6OF01DHQZF.9.9.A09.1.454.CMB.1.raw
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (650)..(650): a, c, t, g, unknown or other
  misc_feature (650)..(650): n is a, c, g, or t
  modified_base (653)..(654): a, c, t, g, unknown or other
  misc_feature (653)..(654): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcacgtgggagcagctccaacatcgggaatcgctatgttgtacacgtggtaccagcagcttccaggaacacgtaccccaaaccctcatctataggtaatagtaactcggccctcgacggggtcccctagaccgtattctcgtggcctaccaagtcgtggcacctcacgccctccgtggccatcgaggtcggccttccgagttctaggaggtactggagtctagtaattagttacgtggtaggagtcgagtgggactagaacgtacggtccgtaagattggtacgttagggtagttcgggttacggggaccgggaacgggacctaacggtcgtaccgggtacccggttaccggtaaggtaccgacggaccccgaaggtcccgtacccggtcccccgttacggtccctaccgttcccgttacccgttccccgtccccttcccgtaccgtaacgttaccgtacgttaccgtacgtcgggacggtccgggtaccgtacggaaccggtacggccgaacgtacggtaacngngcncanngngn

SEQ ID NO: 42520 - DNA, 570 bp, Homo sapiens
  misc_feature: GYAE6OF01EOLBA.9.9.A09.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (559)..(560): a, c, t, g, unknown or other
  misc_feature (559)..(560): n is a, c, g, or t
  modified_base (564)..(570): a, c, t, g, unknown or other
  misc_feature (564)..(570): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtaccccaaaccctcatctatggtaatagtaatcggccctcgaggggtccctgaccgtattctcgtggctccaagtctggcacctcacgccctcctcggccatccacgtggcttacgnggtctggaggataggaggcttagtaatttattaccncgacctactcctaatgaacagcacgtcctagaagtaggttggtaggttacgtcggggacgggaacgggaaccaagtcgtacgtaccgtacgtaggacacgacccgaacggcctccgtccccgtcggtcctaacttccgttccgtacccctaccctcctacgaacgtacgtactacacgtacggcggcggtacgtcggaaccacggcgacagtganncgtnnnnnnn

SEQ ID NO: 42521 - DNA, 604 bp, Homo sapiens
  misc_feature: GYAE6OF01BJAHP.9.9.A09.1.454.CMB.1.raw
  modified_base (588)..(588): a, c, t, g, unknown or other
  misc_feature (588)..(588): n is a, c, g, or t
  modified_base (597)..(598): a, c, t, g, unknown or other
  misc_feature (597)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaaatagtaatccggccctcgacggggtccctgaccgattctctggctccaagtctggcacctcagcctcctgccatcacgtgggcttcgaggctgaggatgaggctgtattatactcgcctactctatgacagcagcctgagagtgtggtagtcggcggaggaccaaggctcgtacccgtccgtaggtcacgtacccgaacggtccgtaccgtccccccgttccggtaccctaccgttacccgttcccgtttacccccctacccccgttaccccgtacccgtaaccggtaaccgttaccgttacccgtaaccgttcggaccggtccgggaccggttccgggaccggtaaaccgggtccgaccgtaaggtacgacncgactgacnncngngn

SEQ ID NO: 42522 - DNA, 468 bp, Homo sapiens
  misc_feature: GYAE6OF01A3ELY.9.9.A09.1.454.CMB.1.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (458)..(458): a, c, t, g, unknown or other
  misc_feature (458)..(458): n is a, c, g, or t
  modified_base (460)..(468): a, c, t, g, unknown or other
  misc_feature (460)..(468): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattcnctggctcaagtctggcacctcagcctccctggccatccactgggaccttcgaggctgaggatggaggctagattattactcgccactcctatcgacngcagctgagagtgtggtatcgggnggaggacagctgaccgtctagcagccagctcgcccctcgcactctccgtccgcctctcagtacgtatcactgagcggctggcaggcanannnnnnnnn

SEQ ID NO: 42523 - DNA, 555 bp, Homo sapiens
  misc_feature: GYAE6OF01C7PKH.9.9.A09.1.454.CMB.1.raw
  modified_base (229)..(229): a, c, t, g, unknown or other
  misc_feature (229)..(229): n is a, c, g, or t
  modified_base (547)..(548): a, c, t, g, unknown or other
  misc_feature (547)..(548): n is a, c, g, or t
  modified_base (551)..(555): a, c, t, g, unknown or other
  misc_feature (551)..(555): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccctcatctatggtaatagtaatcggccctnacggggtccctgaccgattctctggcctccaagtctggccacctcacgccctcccctggccctactcacgtcgggtcttcaggtctggaggatggagtctagatttattactcgcctacttcctagtcgactagcacgcctaggagtaagtggtggttacgtcggggacggacggaccaaggctacggacccgttcgtacgtcacgcccgaacggcctccgcccctcggtctacctcctccgttccccgcccttcccacgacgtactactcgacgtggacggccgggtgtaccgggcgaacgggcgactagtacgcgnncannnnn

SEQ ID NO: 42524 - DNA, 615 bp, Homo sapiens
  misc_feature: GYAE6OF01AG6KO.9.9.A09.1.454.CMB.1.raw
  modified_base (204)..(204): a, c, t, g, unknown or other
  misc_feature (204)..(204): n is a, c, g, or t
  modified_base (601)..(601): a, c, t, g, unknown or other
  misc_feature (601)..(601): n is a, c, g, or t
  modified_base (606)..(606): a, c, t, g, unknown or other
  misc_feature (606)..(606): n is a, c, g, or t
  modified_base (608)..(613): a, c, t, g, unknown or other
  misc_feature (608)..(613): n is a, c, g, or t
  modified_base (615)..(615): a, c, t, g, unknown or other
  misc_feature (615)..(615): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcgacggggtccctgaccgtattctcgtggcctccaagtctggcacctcagccctcctggccatcacgtgggcttcgaggctggaggatggacggctgtatttacttactgaccacttcctaatgacagcacgtcctggaagtaacggttggttagggttacgttcgggacggggtacggggaacccgaaggccgtcggtacccggttccgtaaggtccgacggaccccgaacgggtccgtcccggaccccccgttccggtcctaccttcccgtttccggttcccccgtccccgttcccgtccgtaacgtaccgtactccgtaacgtcggacggtccgggccggtacggaccgtaacgggccgcgtagtacgngacgngnnnnnngn

SEQ ID NO: 42525 - DNA, 613 bp, Homo sapiens
  misc_feature: GYAE6OF01AJ0QI.9.9.A09.1.454.CMB.1.raw
  modified_base (603)..(604): a, c, t, g, unknown or other
  misc_feature (603)..(604): n is a, c, g, or t
  modified_base (607)..(611): a, c, t, g, unknown or other
  misc_feature (607)..(611): n is a, c, g, or t
  modified_base (613)..(613): a, c, t, g, unknown or other
  misc_feature (613)..(613): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacagtcgggaatcgctatcgttgtacactggtaccagcagcttccaggaacacgtccccaaaccctcatctataggtaatagtaactcggccctgacggggtccctgaccgtattcgtcgtggctaccagtctcggccacctcacgtccctccctggccatctacgtgggccttcgaggctggaggtactggacggcttaggtaactttagttacgtcgacctaaccttcccgtaatcggaaccaggaccacggccttaggaaggttaacggtggtacggttacgttcgggacgggtacgggaacccgaacggcgtagtacgtccgtaccgtacggtcgacgcccgtaaggccgtaccgccccgtcggtctacctccgttccggtaccccgtccctccgtcgtacgtaccgtactccgactaggacggccgggtcgtacggaccggacggtcgtacgtacgtgnntcnnnnngn

SEQ ID NO: 42526 - DNA, 580 bp, Homo sapiens
  misc_feature: GYAE6OF01BU1I6.9.9.A09.1.454.CMB.1.raw
  modified_base (374)..(374): a, c, t, g, unknown or other
  misc_feature (374)..(374): n is a, c, g, or t
  modified_base (569)..(569): a, c, t, g, unknown or other
  misc_feature (569)..(569): n is a, c, g, or t
  modified_base (572)..(580): a, c, t, g, unknown or other
  misc_feature (572)..(580): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccgaggaacacgtcccccaaaccctcatctatggtaatagtaactcggccctcgacggggtccctgaccgtattcgtctggcctaccaaggtctcggccacctcacgccctcccgtggccatccacgttgggccttcgaggctaggaggatggaggtctagtaatttagttactcgacctactctaatgaaccngcacgctagagtagtgtaggtacggtcgggcgggacggacgaagcgtacgacccgtcgtaggtcgaaccgacccgaggtcctccgcccccgttcggtcctaccgtttccgttcccctacccgttcctacgacggtaccgttactcctacgtacggacggcgggtcgtacgggaccgaacggcgaccgtagtacgnacnnnnnnnnn

SEQ ID NO: 42527 - DNA, 811 bp, Homo sapiens
  misc_feature: GYAE6OF01C9FCY.9.9.A09.1.454.CMB.1.raw
  modified_base (792)..(792): a, c, t, g, unknown or other
  misc_feature (792)..(792): n is a, c, g, or t
  modified_base (803)..(803): a, c, t, g, unknown or other
  misc_feature (803)..(803): n is a, c, g, or t
  modified_base (806)..(806): a, c, t, g, unknown or other
  misc_feature (806)..(806): n is a, c, g, or t
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
tcagtgatacgtctcacgaccggtgctcgatttagcgagacgcgcagggtcctgggcccagtctgtgctgacgcagccgccctcagtgtctggggccccagggcaggagggtcaccatctcctgcacgtgggagcagctaccaacagtcgggaatcgctatgttgtacactggtaccagcagtcttccaggaacacgtacccccaaaccctcatctataggtaatagtaactcggccctcgacgggtcctgaccgtattctctggcctccaagtctcggccacctcacgtccctccgtgccatccacgtcgggccttcgaggctaggacggtagtaggacggtcttagtactttaacgttaccgtcgacccttaaccgttccgtaaagtaccgaacgtacgaccgtaacggtccgtaaggtaagggtaaacggtttcgggttaacgggtttacggttaccgggggaccgggggaaaccgggtaacccgtaacgggtaccccgttacggtaacccccggttacggttaaaccgggtacccgtaacccgggaacccccggttaacgggtccccgtttaaccccccgggtcccccccgtttaccgggttaccccttacccgtttaccccgttccccggtttaaccccccccttaccccgttaccccttaacccgggtaaccgtttaaccccggtttaacctacccggttaaccggtaccgggggtaccggtacccgggggtacgtaaccggggaacccggtaaccggggtacccggtaacgacggttagaccggngactcgacgancgngngng

SEQ ID NO: 42528 - DNA, 750 bp, Homo sapiens
  misc_feature: GYAE6OF01A15YK.9.9.A09.1.454.CMB.1.raw
tcagtgatacgtctcacgaccggtgctcgatttagcgagacgcgcagggtcctgggcccagtctgtgctgacgcagccgccctcagtgtctgggccccaggcagaggtcaccatctcctgcactgggagcagctccaacagtcggaatcgctattgttgtacactggtaccagcagcttccaggacacgtaccccaaacctcatctagtggtaatagtaatcggaccctcgacggggtccctgaccgtattcctcgtcggcctccgaagttctcggactaccctcacggcccttcccgtcggacccaattccgaacgttcggggtccctttacggaacggtcgttacggaagggtagttcgggacggtccgttaggttaacgttttaacgttaccgtcggtacccctaacgttacccgttaagtacggaaccgtacgaccgtacgtacctaggaaggtaaacggttcggttaggttacggtttcgggaacggggtacggaaccctaaggtccgtacgtacccggttacgtacggttaccgacgacccgtaacgggtcccttccggacccccgtttacggtccttacccgttccgtacccggtttacccccaacccgttccgttaaccgtaacggtacccttaagtaccccgtaacgttaccgggaccgggtcccgggtagttaccggggtaccctaaacggggcccgtaagtaaccggtagacgttaccggcgtgacgagtctgtcgacg

SEQ ID NO: 42529 - DNA, 480 bp, Homo sapiens
  misc_feature: GYAE6OF01A6VH8.9.9.A09.1.454.CMB.1.raw
  modified_base (205)..(205): a, c, t, g, unknown or other
  misc_feature (205)..(205): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (471)..(480): a, c, t, g, unknown or other
  misc_feature (471)..(480): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaaaacgtccccaaaccctnatctatggtaatagtatcggcctcgaggggtccctgaccgattctctggctccaagtctggccacctcagcctccctggcccatcactgggcttcaggctgaggatggaggctagtattatactgccctactcctatcgacagcagcctagagagtgtggtattcggcggaggacagctgccgtctagcngaccagctcgccctggcnctctctccccncctcacacgtactatccatgacgccggctcggcacggcnctanggcnnnnnnnnnn

SEQ ID NO: 42530 - DNA, 668 bp, Homo sapiens
  misc_feature: GYAE6OF01BMC3Q.9.9.A09.1.454.CMB.1.raw
  modified_base (659)..(668): a, c, t, g, unknown or other
  misc_feature (659)..(668): n is a, c, g, or t
tcagtgatacgtctcacgaccggtgctcgatttagcgagacgcgcagggtcctgggcccagtctgtgctgacgcagcccgccctcagtgtcgtcgggccccagggcaggagggtcaccatctcctgcacgtgggagcagctccaacagtcgggaatcgctatgttgtacacgtggtaccagcagtccttccaaggaaccaccgtacccccaaaacccctcactctataggtaaatacggtaactccggccctcggaccgggggtccctgaccgtattcctcgtcggcctaccaagttccgtcggccaaccctcacgccccttccctcggccctacgttccgaccgttcggggtaccttcggacggtcgtagggacggagtaggacggtcgttaggttaattttaacttacgttccgaccttaacccttcccttaagcgtaacacggacacggtcgtaaggtacggtaaggttggtaggttacggttcggggacgggaacgggaacgacggtcgtacggtcccgtaccgtaggaccacgacccgacggtccgtccggccccgtcgtccacgttccgttacccgttcccgtccctacctcctacggtacctactaccacggtcggaccggcgggtcgtcggaacgacggcgacgatacggnnnnnnnnnn

SEQ ID NO: 42531 - DNA, 675 bp, Homo sapiens
  misc_feature: GYAE6OF01A9C7G.9.9.A09.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (665)..(665): a, c, t, g, unknown or other
  misc_feature (665)..(665): n is a, c, g, or t
  modified_base (672)..(672): a, c, t, g, unknown or other
  misc_feature (672)..(672): n is a, c, g, or t
tcagtgatacgtctcacgaccggtgctcgatttagcgagacgcgcagggtcctgggcccagtctgtgctgacgcagcccgccctcagtgtctgggccccagggcagagggtcaccatctcctgcactgggagcagctccaacatcgggaatcgctatgttgtacactggtaccagcagcttccgaggaacacgtcccccaaaacccctnatctataggtaatagtaatccggccctcgacggggtccctgaccgtattctcgtgcctccaagtctggccacctcagccctccnggccatcacgtgggcttcgaggctggaggntgaggtctagtatttatacgtcgacctactctatcgacagccacgtccgtaggaaggtacgttggttagggttacgttcggggaccgggtaacgggacccaaggtcgtacggtaacccggttccgtacgggtacgaccggaccccgaacgggtcccgttcccggccccccgttaccgggttaccctaccctttcccgttacccggtttacccccctaaccccgttcccgtacccggtaacggttaacccgttaaccgtccgtaaccgtacgggaccgggtccgggtaccgttaccggggaacggaacccgggtaccggtaccgtaagttacggcacgtgacngatcgcnggc

SEQ ID NO: 42532 - DNA, 518 bp, Homo sapiens
  misc_feature: GYAE6OF01AO9QX.9.9.A09.1.454.CMB.1.raw
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (515)..(518): a, c, t, g, unknown or other
  misc_feature (515)..(518): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcaggggtccctgaccgattctctggctccaagtctggcacctnagccctcctggcccatccacgtgggcttcaggctgaggntggagctgattatactgccactcctatgacagcaagtcctggaataacggttgtacggtaattccgggacggagggtaccaagcgtacgaccgtccgtaggtcacgacccaagggctcgccccgtgtcactctacgtcccacctcctacagtacgtancacgtgacgcggtcnggacgaacggtccagactacgatcntnagannnn

SEQ ID NO: 42533 - DNA, 660 bp, Homo sapiens
  misc_feature: GYAE6OF01D501R.9.9.A09.1.454.CMB.1.raw
  modified_base (255)..(255): a, c, t, g, unknown or other
  misc_feature (255)..(255): n is a, c, g, or t
  modified_base (649)..(649): a, c, t, g, unknown or other
  misc_feature (649)..(649): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
tcagtgatacgtctcacgaccggtgctcgatttagcgagacgcgcagggtcctgggcccagtctgtgctgacgcagcccgccctcagtgtctggggccccagggcagagggtcaccatctcctgcactgggagcagctccaacatcgggaatcgctatgttgtacactggtaccagcagcttaccaggaacacgtacccccaaaccctcatctatggtaatagtaatcgccctgacggggtccctgaccgattcnctggctccaagtctggcacctcacgtccctcctgccatcacgtggtcttcgaggctaggaggatggagtctagtattagtactcgcctactcctatcgacgagcctacgccgtagaacggtaaggtggttaggtacggttcgggacgggtaacgggaaccgtaacggaccgtacggtaacccggttaccgtaggtacccgaaccggtaccccgaacgggtccccgtcccggtccccccgtacggtacccgtaccctttaccggttcccgttcccccgtaccccgttaccgtacccgtaacggtaccgttaaccgtaccctaccggtacggacgggtccgggtaccgtacggggacccgtaacgggcctaccgaacggttcgacgtcgaccgtanacnncngngng

SEQ ID NO: 42534 - DNA, 510 bp, Homo sapiens
  misc_feature: GYAE6OF01A0Q5R.9.9.A09.1.454.CMB.1.raw
  modified_base (311)..(311): a, c, t, g, unknown or other
  misc_feature (311)..(311): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (507)..(510): a, c, t, g, unknown or other
  misc_feature (507)..(510): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacagtccccaaaccatcatctatggtaatagtaatcggccctcaggggtccctgaccgattctctggctccaagtctggccacctcacgcctccctggccatcacgtgggcttcgaggctgaggntgagctgattatactgccactcctatgacagcagcctagagtagtgtggtagtcggcggtaggaccaagtctcgacccgtcgtaggtccacgcccgaaggcctcgccccctcggtctacctcctcgtccccaccctccctacacgtaccgtactccacgtcgcggcggctcggacgacggcncagtcgngctnnannnn

SEQ ID NO: 42535 - DNA, 653 bp, Homo sapiens
  misc_feature: GYAE6OF01DMXJK.9.9.A09.1.454.CMB.1.raw
  modified_base (208)..(208): a, c, t, g, unknown or other
  misc_feature (208)..(208): n is a, c, g, or t
  modified_base (549)..(549): a, c, t, g, unknown or other
  misc_feature (549)..(549): n is a, c, g, or t
  modified_base (636)..(636): a, c, t, g, unknown or other
  misc_feature (636)..(636): n is a, c, g, or t
  modified_base (644)..(645): a, c, t, g, unknown or other
  misc_feature (644)..(645): n is a, c, g, or t
  modified_base (649)..(650): a, c, t, g, unknown or other
  misc_feature (649)..(650): n is a, c, g, or t
  modified_base (653)..(653): a, c, t, g, unknown or other
  misc_feature (653)..(653): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacatcgggaatcgctatgttgtacacgtggtaccagcagcttccaggaacacgtaccccaaaccctnatctataggtaatagtaatccggcccttcgacgggtccctgaccgtattctcgtggcctaccgaagtctacggccacctccacgtccctccgtggccctatccgacgtcgggcttcgaggtcctggaggatggaggtctagtacttagtacctgtaccctattccctagtacggaaccaggccaaggtcccgttaggaacgtaaggttggttaggttacggttccgggacgggaacgggtaccaagggtccgttacggacccgttcgtaacggtaccgaccggtaccgaacgggtccttacccggccccgttcgtacctacccgttctacccgttaccccnccccgttaccgtccgtaccgtaccgttactccgaacgtcggaaccggtcgggtccgtacgggaccgaaggtccgtactaagtaggcngcgtacgnngacnngtn

SEQ ID NO: 42536 - DNA, 485 bp, Homo sapiens
  misc_feature: GYAE6OF01DWMGI.9.9.A09.1.454.CMB.1.raw
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
  modified_base (475)..(476): a, c, t, g, unknown or other
  misc_feature (475)..(476): n is a, c, g, or t
  modified_base (479)..(485): a, c, t, g, unknown or other
  misc_feature (479)..(485): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctnatctatggtaatagtaatcggccctcaggggtccctgaccgattctctggctccaagtctggcacctcagcctccctggccatcactgggcttcaggctgaggatgaggctgattatcngccactctatgacagcagcctagagaagtgtaggtattcgggcgggagggaccaagctgaccgtctaggtcacgcccaggctcgcccccgtgtccactctcttccccaccctcctcagcgtancactgacgcggctggcgaaggcnatagnncgnnnnnnn

SEQ ID NO: 42537 - DNA, 584 bp, Homo sapiens
  misc_feature: GYAE6OF01BT2S3.9.9.A09.1.454.CMB.1.raw
  modified_base (132)..(132): a, c, t, g, unknown or other
  misc_feature (132)..(132): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (578)..(584): a, c, t, g, unknown or other
  misc_feature (578)..(584): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggancagctccaacatcgggaatcgctatgttgtacatggtaccagcagcttccaggaacagtcccccaaaccctcatctatggtaatagtaactcggccctcgacgggggtccctgacccgtattcctcgtggcttccaagttcctggccacctcacgccctccctggcccatcacgtgggccttcgaggctggaggtatggaggtctgactttatctcgcctactcctatcgaacacgcacgtcctaggagtaaacggttgttagggtactttcggggacgggaggaaccgaggctacggaccgttccgtaaggtcacgacccgaacggcctacccgtccccgtcggtccaccgttcctccgttcccaccgttcctccgtacctacgtaccgtactaccgacgtacgaccggcggtcgtcgggacgtaacggcgacgtagngacncgnnnnnnn

SEQ ID NO: 42538 - DNA, 686 bp, Homo sapiens
  misc_feature: GYAE6OF01C83GX.9.9.A09.1.454.CMB.1.raw
  modified_base (137)..(137): a, c, t, g, unknown or other
  misc_feature (137)..(137): n is a, c, g, or t
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
  modified_base (657)..(657): a, c, t, g, unknown or other
  misc_feature (657)..(657): n is a, c, g, or t
  modified_base (678)..(686): a, c, t, g, unknown or other
  misc_feature (678)..(686): n is a, c, g, or t
tcagtgatacgtctcacgaccggtgctcgatttagcgagacgcgcagggtcctgggcccagtctgtgctgacgcacgcccgccctcagtgtcgtcgggccccagggcaggagggtcaccatctcctgcacgtgggancagcctaccaacagtcgggaatcgcttatgttagtactacgtcggtaccagcagtccttaccgaaggaaccaccgtacccccaaaacccctcattctaagtaggtaaattagtaactccggcccctacggacggggtccctaggaccgtattcctcgtcggtccttaccgaagttccgtacggtacccacccgttccgaccgtcccttaccccgaggaccctaagttccgtaaccggtcgggttaccttaccgggaggtccgtagggaggtaacgtgggaacggtcttagtaactttactaccgtcgaccctacgttacctacgacgacgacgacacggtctaggaagggttagtcggttaagggttacgtcgggggacgggaacgtaaccgagtcgtaccggtacccgtgtacgggacaaccgggcccaacggtccgtaccccgtacccgtcgtaccctacgttcccgttcccgtcccgacctcccgagacgtacgttcncgtacgnggcggtcggacncgggacacggtcatagcgacnnnnnnnnn

SEQ ID NO: 42539 - DNA, 682 bp, Homo sapiens
  misc_feature: GYAE6OF01EDYCZ.9.9.A09.1.454.CMB.1.raw
  modified_base (164)..(164): a, c, t, g, unknown or other
  misc_feature (164)..(164): n is a, c, g, or t
  modified_base (398)..(398): a, c, t, g, unknown or other
  misc_feature (398)..(398): n is a, c, g, or t
  modified_base (652)..(652): a, c, t, g, unknown or other
  misc_feature (652)..(652): n is a, c, g, or t
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
  modified_base (674)..(674): a, c, t, g, unknown or other
  misc_feature (674)..(674): n is a, c, g, or t
  modified_base (679)..(680): a, c, t, g, unknown or other
  misc_feature (679)..(680): n is a, c, g, or t
tcagtgatacgtctcacgaccggtgctcgatttagcgagacgcgcagggtcctgggcccagtctgtgctgacgcagcccgccctcagtgtctcgggccccaggcagaggtcaccatcctcctgcacgtgggagcagctaccaacagtcggaatcgactatgttntacactggtaccagcagtcttaccgaaggaaccaccgtacccccaaacctcatactagtagtaatagtaacgtccggcccgtcggaccgggttccctacgaccgtactttccgtcgtcggtcccttaccgaagttccgacggtaccctaaccgttccgaccggtccccttcccggtaccggacctaacgttcccgtacgtccgggtccttaccggaacggtccgtaggaacggngtacggaggtctagtactttacgtacgtcacctcttacagtcgtaccagccgtagtccgtaagtagtacggttggtacgtagttcgggacggtaccgacgacgtcgacgtaccgtcgtacgtacgaccgaccgacgtcgtcccgccccgtcgtccgtacgttcgtcccgtccccgtcccgttacccgaccgtacgtaccgtaccgtacgacggtaccggtcggtaccggcggtacccgggaagtacccgggtanacgtacgtanacngtagcgtanatcgnngc

SEQ ID NO: 42540 - DNA, 653 bp, Homo sapiens
  misc_feature: GYAE6OF01DODGQ.9.9.A09.1.454.CMB.1.raw
  modified_base (646)..(651): a, c, t, g, unknown or other
  misc_feature (646)..(651): n is a, c, g, or t
  modified_base (653)..(653): a, c, t, g, unknown or other
  misc_feature (653)..(653): n is a, c, g, or t
tcagtgatacgtctcacgaccggtgctcgatttagcgagacgcgcagggtcctgggcccagtctgtgctgacgcagcccgccctcagtgtctgggccccagggcagagggtcaccatctcctgcacgtgggagcagctccaacatcgggaatcgcttatgttgtacactggtaccagcagcttccaggaacacgtaccccaaaccctcatctaagtggtaatagtaactccggccctcgacggggttccctgaccgattcctcgtgacctccgaagtccgtggccacctcacgtccctcccgtggccatcacgtgggcttcgaggtctgaggagtggaggtctagtattactactcgcctacttacctagtacgaccagtcagcccgtagaagggtaggttcggtaggttaggttaccgggacggggtaagggaaccgaacgtaccggttacgacccgggtacccgttaagggtaccgtaacgaccccggaacggtcccgtccccggtcccccgtcggttaccctaccgttcccgttcccgttaccccaccccgttccctaccgtaacgtaccgttactaccgtacgttcgggacggtaccggggtcgacgggtaccgaacgggtacggtactaaacggtcagctnnnnnngn

SEQ ID NO: 42541 - DNA, 168 bp, Homo sapiens
  misc_feature: GYAE6OF01E1PEE.9.9.A09.1.454.CMB.1.raw
  modified_base (132)..(168): a, c, t, g, unknown or other
  misc_feature (132)..(168): n is a, c, g, or t
tcagtgatacgtctcacgaccggtgctcgatttagcgagacgcgcagggtcctgggccccagtctgtgctgacgcagccgccctcagtgtctgggccccagggcagagggtcaccatctcctgcactgggannnnnnnnnnnnnnnnnnnnnnnnnnnnnnnnnnnnn

SEQ ID NO: 42542 - DNA, 538 bp, Homo sapiens
  misc_feature: GYAE6OF01BKLQZ.9.9.A09.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (534)..(536): a, c, t, g, unknown or other
  misc_feature (534)..(536): n is a, c, g, or t
  modified_base (538)..(538): a, c, t, g, unknown or other
  misc_feature (538)..(538): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgctatgttgtacactggtaccagcagcttccaggaacacgtccccaaaccctcatctatggtaatagtaatccggccctcgacggggtcccagaccgtattctcgtggcctccaagtctggccacctcagccctccgtgccatcacgtgggcttcgaggctgagntgaggctgatttactcngccatcctagcgacngcacgctaggagtagttgtagtagttcgggacgggacggaccaagcgtgtacccgtacgtacgtcacgcccaaggtcctcgcccccgtgccaccgttctaccgttccccaccctcctaccgacgtacgtctactacgtcgacggccggcgtcgggacgaacggcgtacgtagtcgntnacgncgannngn

SEQ ID NO: 42543 - DNA, 632 bp, Homo sapiens
  misc_feature: GYAE6OF01EDK69.9.9.A09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (627)..(631): a, c, t, g, unknown or other
  misc_feature (627)..(631): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcactgggagcagctccaacatcgggaatcgcttatgttgtacactggtaccagcagcttcaggacacgtccccaaaccctnactcgtatggtaaatagtaacgtccggaccctcgacggggtcccctgaccgatttcncgnggctccaagtcctggccacctnacgcctccgtgacctatccgacgtgggtcttcgaggcgtagacggtatcggagcttagtatttattacgcgtccacgttcctagtcgaaccgagcacgccgtaggaacgtaaggttggtacggttacgtacgggacgggtaaacggaccgtaaggacctacggtaacccgttcgttaacggttaccgagtaccccggaacggtcccgtcccgtacccccgttcggtaccctccgtttacccgttcccgttcccccgtaacccgtccgtaacgtaccgtaacgttacgttccgaacgttcgggacggtcggtcgtcggaccgacggtcagactagcgncncgnnnnnc

SEQ ID NO: 42544 - DNA, 675 bp, Homo sapiens
  misc_feature: GYAE6OF01EXXZV.9.9.A09.1.454.CMB.1.raw
  modified_base (145)..(145): a, c, t, g, unknown or other
  misc_feature (145)..(145): n is a, c, g, or t
  modified_base (208)..(208): a, c, t, g, unknown or other
  misc_feature (208)..(208): n is a, c, g, or t
  modified_base (666)..(675): a, c, t, g, unknown or other
  misc_feature (666)..(675): n is a, c, g, or t
tcagtgatacgtctcacgaccggtgctcgatttagcgagacgcgcagggtcctgggcccagtctgtgctgacgcagccgccctcagtgtcgtcggggccccagggcagagggtcaccatctcctgcacgtgggagcagctccaanatcgggaatcgctatgttgacactggtaccagcagcttccaggaacacgtcccccaaaccctnatctatggtaatagtaactcggccctcgacggggtccctgaccgtatttcctacgtggcctaccgaagttccgtaggaccacccttcaccgtcccttacccgtcgggaccaacttccgaacgttcggggtacctttcgacgggtccgttagggaaggtacgtaggacggtctttacggtaattttacttaccgtaccgaccctaaccttcctaagtcgaaccaggtccaaggtccgtaggaacggtaagttggttaggttacggttccggggacgggaacggacgaagtccgtacggaccgtacggtacggtaccgacgacccgtacggtccgtaccgtcccccgtacggttcctacccgtttcgttccccgttaccccctccccgttaccgtaccgaacgtaccgttactccgtacgtaggccggtcgggtcgtacgggacgtacggcgagagacgnnnnnnnnnn

SEQ ID NO: 42545 - DNA, 707 bp, Homo sapiens
  misc_feature: GYAE6OF01BF7YI.9.9.A09.1.454.CMB.1.raw
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (701)..(707): a, c, t, g, unknown or other
  misc_feature (701)..(707): n is a, c, g, or t
tcagtgatacgtctcacgaccggtgctcgatttagcgagacgcgcagggtcctgggcccagtctgtgctgacgcagcccgccctcagtgtcgtcggggccccaggggcaggagggtcaccatctcctgcactgggagcagctccaacatcgggaatcgctatgttgtacacgtggtaccagcagcttaccgaggaacacgtacccccaaaccctcatctattaggtaatagtaagtccggacccgtaacgggggtccctcgaccgtactttctcgtcgggcctacctaagttccgtacggcccaacctccaccggtcccttcccccgtcgggaccctactccgtaccggttcggggtccttacggacgggtcgtagggaggtagtaggaggtcttaggtaatttaacttactccgacccttacgttaccttagacgtacgacacgaacggtccgtaggaaggtaggttggttaggtaggtccggggacgggaacgggacaacggtccgtacggtaccgtaccggtacggaccaccggtacccggtaacggcccgttcccggtacccccgttcggtaccctaccgttcccgttaccccttccccctacccttcccgtaaccgtaccgtacgttaccctaccgtaccggtcgggacgggtccgggacgtcgggaaccgtacgggcgtacgagtagacngcncnnnnnnn

SEQ ID NO: 42546 - DNA, 657 bp, Homo sapiens
  misc_feature: GYAE6OF01BSXPA.9.9.A09.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (652)..(655): a, c, t, g, unknown or other
  misc_feature (652)..(655): n is a, c, g, or t
tcagtgatacgtctcacgaccggtgctcgatttagcgagacgcgcagggtcctgggcccagtctgtgctgacgcagcccgccctcagtgtcgtcggggccccagggcagagggtcaccatctcctgcacgtgggagcagcctccaaacagtcgggaatcgcttatgttgtacacgtggtaaccagcagcttccgaggaacncgtaccccaaaccctcatctatagtaatagtactcgccctgacgggtccngacgtattcngtcggctaccgaagtcctcggaccacctcgactcccgtccgtcggacctataccgtacgttcggacctttcggacggtcagggtaaggtagtcggagtctagtaacttttacgtacgtaccgacctactacctagtacgaccacggtcctacggtcgaaggtaacgtaagggtcgttaggttacgtacgggacggacggtaaccgacgtcgtacggtacccggtacgtacggtacacggacccgacgtcccgtaccgtcccccgtacggtccctccgttaccgtcccgttcccccgcccttccgtaccgtacggtaccttactccggtagtaccgggtacggccgggacgtacggtaccggaaaggtccggataacggngacngngcncgnnnngc

SEQ ID NO: 42547 - DNA, 811 bp, Homo sapiens
  misc_feature: GYAE6OF01CGDT5.9.9.A09.1.454.CMB.1.raw
  modified_base (797)..(797): a, c, t, g, unknown or other
  misc_feature (797)..(797): n is a, c, g, or t
  modified_base (804)..(804): a, c, t, g, unknown or other
  misc_feature (804)..(804): n is a, c, g, or t
  modified_base (806)..(806): a, c, t, g, unknown or other
  misc_feature (806)..(806): n is a, c, g, or t
  modified_base (808)..(808): a, c, t, g, unknown or other
  misc_feature (808)..(808): n is a, c, g, or t
tcagtgatacgtctcacgaccggtgctcgatttagcgagacgcgcagggtcctgggcccagtctgtgctgacgcagccgccctcagtgtcgtgggccccagggcagagggtcaccatctcctgcactgggagcagcctccaaacagtcgggaatcgctatgttgtacactggtaccagcagtccttaccgaggaacacgtaccccaaacccctcactctagtaggtaaatagtaacgtccgccctcgacggggtccctaggaccgtacttcgtctggcctaccgtaagttccgtcggacctacccgtcaccgtccctaccgtcggcctaactcgtacgttcgggtccttagacggtcgtaggaggtagtcggaagtcttagtaattacgtttactccgtacctaaccgttacccttagtaccgaaacgtacgacccgtaccggttaccggtaagtaaacgggttacggtttcggggtttaacgggtacggtttacccgggggaaccgggaacggggtaaccccgaagtacccggtaccggtaaccccggttacccgtaacgggttacccgaaccgggtacccccggtaaacggttccccgtacccccggttaccccccggttaccggttaccccgttaacccgtttccccgtttacccccgttttacccccccgtaccccctttcccgtaacccgtaaccggttacccgttaccgttaacccgtacggtaccggtaccggtaccggggtccgggtaccggtaccggaacgggtacccggagtaacgaccgtagaccncgcacancngngcg

SEQ ID NO: 42548 - DNA, 787 bp, Homo sapiens
  misc_feature: GYAE6OF01CUF8U.9.9.A09.1.454.CMB.1.raw
  modified_base (134)..(134): a, c, t, g, unknown or other
  misc_feature (134)..(134): n is a, c, g, or t
  modified_base (146)..(146): a, c, t, g, unknown or other
  misc_feature (146)..(146): n is a, c, g, or t
  modified_base (228)..(228): a, c, t, g, unknown or other
  misc_feature (228)..(228): n is a, c, g, or t
  modified_base (491)..(491): a, c, t, g, unknown or other
  misc_feature (491)..(491): n is a, c, g, or t
  modified_base (780)..(780): a, c, t, g, unknown or other
  misc_feature (780)..(780): n is a, c, g, or t
  modified_base (784)..(784): a, c, t, g, unknown or other
  misc_feature (784)..(784): n is a, c, g, or t
tcagtgatacgtctcacgaccggtgctcgatttagcgagacgcgcagggtcctgggcccagtctgtgctgacgcagcccgccctcagtgtcgtcgggccccagggcaggaggtcaccatcctctgcagtgggancacgctaccaanagtcgggaatcgacttagtgttactacacgtacggtaccagtcagtccttaccgaaggaaccaacgtaccccccaaaccctnactactagtacggttaatagtaacgtcccgccctacggacgggttaccctagaccgtattccgtacgtaggtacctaccctaaggtccgtaccggacctacccttaccgaaccgtcccccgttaccgtacggtaccctaacgttccgtaaccggtcgggttaccccttaggacggtaccgtaggtaaggtccgtagggaccggttattaaacgtaacctttaagttaccgtaccgacccttacgttaacctaagtaggaaacnccgggaatacggcgtaacgggtacgtaacggtttacgggtaggtttacggtaccggggacggtaacgggtaacctaacgggtccgttaccggtaaccgtaccgttaaccggtaccgaaccggtaaccgaccggtcccgtacccgtaccccgtccgttaccgttaccgtcccggttaacccgtttaccccgtacccgtaccttaccgtaacgttacctacgaccgttacggcgtacgggtcggtacgtaccggacgaaccggtacgtacgtaagcggtcaggcagtcagngtangac

SEQ ID NO: 42549 - DNA, 707 bp, Homo sapiens
  misc_feature: GYAE6OF01CYRI5.9.9.A09.1.454.CMB.1.raw
  modified_base (216)..(216): a, c, t, g, unknown or other
  misc_feature (216)..(216): n is a, c, g, or t
  modified_base (699)..(699): a, c, t, g, unknown or other
  misc_feature (699)..(699): n is a, c, g, or t
  modified_base (703)..(707): a, c, t, g, unknown or other
  misc_feature (703)..(707): n is a, c, g, or t
tcagtgatacgtctcacgaccggtgctcgatttagcgagacgcgcagggtcctgggcccagtctgtgctgacgcagccgccctcagtgtctgggccccagggcagagggtcaccatctcctgcacgtgggagcagcctaccaacatcgggaatcgctatgttgtacacgtggtaccagcacgtcttaccgaggaaccacgtacccccaaacccctnattactagtaggttaatagtaactccggccctacggacggggtccctaggaccgtattctctcggcctaccgtaagtccgtcggaccaccgtcacgtaccctcccgtcggtaccacgtcgaccggttcgggtcttacggacggtccgtagggaacggtcgtagggtacgtacgtttaacgttaacttttaaccgttacgaccgtacccttaccgtttaccgttagtaaccggtacaacggtcgtaacggtccgtaagggtaaggttaacggtttgggttacgggttacgttaccgggggacgggtaacgggtaaccgacggtccgtacggtacccggttacgtacggtaccgaccgtacccgacgtcccgtacccgtccccgtacgtcctaccttccgtcccgtaccctaccctctaccgtacgtacctacgtctacgtcggaccggtccggcgtacggacgacggtacgtagagtcgctgancgannnnn

SEQ ID NO: 42550 - DNA, 780 bp, Homo sapiens
  misc_feature: GYAE6OF01A3JBA.9.9.A09.1.454.CMB.1.raw
  modified_base (214)..(214): a, c, t, g, unknown or other
  misc_feature (214)..(214): n is a, c, g, or t
  modified_base (764)..(764): a, c, t, g, unknown or other
  misc_feature (764)..(764): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
  modified_base (774)..(775): a, c, t, g, unknown or other
  misc_feature (774)..(775): n is a, c, g, or t
  modified_base (778)..(778): a, c, t, g, unknown or other
  misc_feature (778)..(778): n is a, c, g, or t
  modified_base (780)..(780): a, c, t, g, unknown or other
  misc_feature (780)..(780): n is a, c, g, or t
tcagtgatacgtctcacgaccggtgctcgatttagcgagacgcgcagggtcctgggcccagtctgtgctgacgcagcccgccctcagtgtctgggccccagggcagaggtcaccatctcctgcacgtgggagcagcctaccaacagtcgggaatcgcttatgttgtacacgtgtaccagcagtcttaccgagaaccacgtacccccaaaccctnatctagtagtaatagtacgtccgccctacggtacgggtccctagaccgtacttcgtcgtcgtacctaccgtaagtcgtacggacctaccgtacctacgtccccgttcccgtaccggaccctacgttccgtaaccggtcggggtaccctttaccggacgggtaccgtagggtaacgggtaaggtcgggtacgggtctttacggttaaacttttaaacgtttccgtacccggttaccctaacccgtttcccttaagtacggaaccgtacgacggtaccgtaccgttaaggaacggttaaaggttcgggtttacgggtacggttaccggggaaccgggtaacgggaaccgtaacgtccgtaaccggtacccggtacggtacggtaccgaccggtacccgtacggtccgttcccgaccccggtttacgtacccgttaccgttccgttaccccgttacccccgttaccccttaccgtaccgtaacggtacccttacgaccgttacgtacggccggtccggtacgtcggaaccggtacggaccgagtacggtacgngngngcgacnntgngn

SEQ ID NO: 42551 - DNA, 794 bp, Homo sapiens
  misc_feature: GYAE6OF01BSN7Z.9.9.A09.1.454.CMB.1.raw
  modified_base (402)..(402): a, c, t, g, unknown or other
  misc_feature (402)..(402): n is a, c, g, or t
  modified_base (782)..(782): a, c, t, g, unknown or other
  misc_feature (782)..(782): n is a, c, g, or t
tcagtgatacgtctcacgaccggtgctcgatttagcgagacgcgcagggtcctgggcccagtctgtgctgacgcagcccgccctcagtgtcgtcggggccccagggcaggagggtccaccatcctcctgcacgtgggagcagctaccaacagtcgggaatcgctatgttgtacactggtaccagcagtcttccaaggacaccgtacccccaaaccctcatctagtagtaatagtacgtccggacctcgtacgggttccctgtaaccgtatttccgtcgtcggacccttaccgtaaacgttccgtcggacctaacccgtacctaccggtccccttcccgtccggaccctacttccgtacggttcgggtaccttaccggaggtccgtaggacggtagtacgggnggtactgttaacttattaccgacctacctactctaagtcgacgacgactacggacgttaggaaggttaacggttggttaacgggttcggtacgggggaaccgggtaacgggtaacgtaacggtaccggttaccggtaacccggttaccggttaacggaccggtaacccggaaccccggtaccggttcccggtaacccccggtccccgttaacccgggtacccttaccccgtttcccgttacccgtttcccccgtcccgttaccctaccgtaacggtaaccgtaccgttacgtaccggtcggtaccgggaccgggttccgggaccgggaacccgggtaacgggtccggtaacgaacggttacggctacggtcacggtacgnaacgtgacgtcg

SEQ ID NO: 42552 - DNA, 886 bp, Homo sapiens
  misc_feature: GYAE6OF01CTWGI.9.9.A09.1.454.CMB.1.raw
tcagtgatacgtctcacgaccggtgctcgatttagcgagacgcgcagggtcctgggcccagtctgtgctgacgcagcccgccctcagtgtcgtcggggccccagggcagagggtcaccatcctcctgcacgtgggagcagcctacccaaacagtcgggaatcgctatgttgtacacgtggtaccagcagccttaccgaaggaaccacgtacccccaaaccctcactctaagtaggtaaattacgtaacgtccggccctacggacggggttccctaggaacccgtattcctcgtggcctaccgaagttccgtggacctaccctcaccgtcccctccccgtggccctacgtccgacggtacgggtccttaccggaggtccgtagggaacggttacgtacgggaacggtcgttaaggtaactttaacgttacccggtcgtaaccctaccgtttaccgtaaagtacgtaacgtacggtaccgtaacgggtcccttaagggtaaacggttaagggttcgggtttacgggtttaccgggtaccgggggtaacggggtaaaccgggtaaccgtaacgggtaccggttaacccgggtaacccggtttaccgggttaaccggtaccggtaaacccggtacccgggtaaccgggttcccgttccccccgggttacccccggttcgttacccgtaccccgtttcccggtttaacccccgtttccccccctaaaccccgttcccgttaaccggtaacccgggtttacccgttaacggtacccggttaaaccgggtcgggtaacccggggtcccggggtacctaccgggggccgtaaaacgggggtccccgttaaacgttcgggaaacctcggcgtactacgacgtagaactcgtgtcg

SEQ ID NO: 42553 - DNA, 669 bp, Homo sapiens
  misc_feature: GYAE6OF01EXS9Q.9.9.A09.1.454.CMB.1.raw
  modified_base (134)..(134): a, c, t, g, unknown or other
  misc_feature (134)..(134): n is a, c, g, or t
  modified_base (221)..(221): a, c, t, g, unknown or other
  misc_feature (221)..(221): n is a, c, g, or t
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
tcagtgatacgtctcacgaccggtgctcgatttagcgagacgcgcagggtcctgggcccagtctgtgctgacgcagccgccctcagtgtctgcgtctcctggacagtcgatcaccatctcctgcactggaaccngctagttagggtactttttaacctgtcctccgtacggtaaccaaccacccaaccgaggaccaaaccgccccaaatcaatgtatttanaggaacgtcaactaacgccggtcccgtagggtactttcgacggtcctcgtcttctcgtcggtcctaccgtaagtccgtaacaaccgtaccggccctccgtagaactaaccgtctaccggnggacctcgtagacgtggacgggacaggtctagtaagtttacttacgtgttctacttanatacagtaggtagttaggttcgggttggtcgtcgggagggtaaccgctaagccgtacggtacccgtgttaacggccgtacgacccgtaacgtcggtaccccgtcccggtacgtccgtacgttccgttaccccgtccccgttccgtacccgttacgtacgtactaccgaccggttcggaacgggttcggacccgggttacgaacgggtaccgtacgtacgtaacggtacngtcngtaccgngtcgntgtacnctgacgtactngancnngn

SEQ ID NO: 42554 - DNA, 478 bp, Homo sapiens
  misc_feature: GYAE6OF02ICXEL.9.9.A09.1.454.CMB.1.raw
  modified_base (470)..(478): a, c, t, g, unknown or other
  misc_feature (470)..(478): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtcccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtctaggtcagcccaaggctgcccctggtcactctcgttcccaccctcctcagcgtatcactgagcgggctggcaggcgcatagnnnnnnnnn

SEQ ID NO: 42555 - DNA, 485 bp, Homo sapiens
  misc_feature: GYAE6OF02F6GGN.9.9.A09.1.454.CMB.1.raw
  modified_base (475)..(476): a, c, t, g, unknown or other
  misc_feature (475)..(476): n is a, c, g, or t
  modified_base (478)..(485): a, c, t, g, unknown or other
  misc_feature (478)..(485): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactgggcttcaggctgaggatgaggctgattattactgccagtcctatgacagcagcctgagaagtgtggtattcgggcggagggaccaagctgaccgtctaggtcagcccaaggctcgcccctcggtcactctcgttcccaccctcctccagacgtatcactgagcgggctggcaaggcgcagtagnngnnnnnnnn

SEQ ID NO: 42556 - DNA, 484 bp, Homo sapiens
  misc_feature: GYAE6OF02JEYKL.9.9.A09.1.454.CMB.1.raw
  modified_base (475)..(476): a, c, t, g, unknown or other
  misc_feature (475)..(476): n is a, c, g, or t
  modified_base (478)..(484): a, c, t, g, unknown or other
  misc_feature (478)..(484): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctccctggccatcactgggcttcaggctgaggatgaggctgattattactgccactcctatgacagcagcctgagaagtgtggtattcggcggagggaccaagctgaccgtctaggtcagcccaaggctcgccccctcggtcactctcgttcccaccctcctcagagtactcactgagcgggctggcaaggcgcatagnncnnnnnnn

SEQ ID NO: 42557 - DNA, 481 bp, Homo sapiens
  misc_feature: GYAE6OF02I0WXZ.9.9.A09.1.454.CMB.1.raw
  modified_base (458)..(458): a, c, t, g, unknown or other
  misc_feature (458)..(458): n is a, c, g, or t
  modified_base (473)..(481): a, c, t, g, unknown or other
  misc_feature (473)..(481): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctccctggccatcactgggcttcaggctgaggatgagctgattatactgccactcctatgacagcagcctgagaagtgtgtattcggcggagggaccaagctgaccgtctaggtcagcccaggctcgcccctcggtcactctcgttccccaccctcctcagtacgtatccactgagcgggcnggcagggcacatagnnnnnnnnn

SEQ ID NO: 42558 - DNA, 499 bp, Homo sapiens
  misc_feature: GYAE6OF02IVN65.9.9.A09.1.454.CMB.1.raw
  modified_base (490)..(490): a, c, t, g, unknown or other
  misc_feature (490)..(490): n is a, c, g, or t
  modified_base (493)..(499): a, c, t, g, unknown or other
  misc_feature (493)..(499): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcagcctcctggccatcactggcttcagctgagatgagctgattatactgccactcctaatgacagcagcctagagagtgtggtattcggcggaggaccaagctgaccgtccgtagtcagcccaaggcctacgccccgtcggtccactctcgttcccgcccttcctcacgactacgtcactggagccgggctcggacaacgggccacgtagtacggacngcnnnnnnn

SEQ ID NO: 42559 - DNA, 489 bp, Homo sapiens
  misc_feature: GYAE6OF02GJXF8.9.9.A09.1.454.CMB.1.raw
  modified_base (366)..(366): a, c, t, g, unknown or other
  misc_feature (366)..(366): n is a, c, g, or t
  modified_base (474)..(474): a, c, t, g, unknown or other
  misc_feature (474)..(474): n is a, c, g, or t
  modified_base (480)..(489): a, c, t, g, unknown or other
  misc_feature (480)..(489): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggnggagggaccaagctgaccgtcctaggtcagcccaaggctcgcccctcggtcactctcgttccccaccctcctcacgtaccgtactcactgagcgggctggcaagggcncatagnnnnnnnnnn

SEQ ID NO: 42560 - DNA, 484 bp, Homo sapiens
  misc_feature: GYAE6OF02GLW3V.9.9.A09.1.454.CMB.1.raw
  modified_base (475)..(484): a, c, t, g, unknown or other
  misc_feature (475)..(484): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagagtgtggtattcggcggaggaccaagctgaccgtcctaggtcagcccaaggcctgccccctcggtcactctcgttcccaccctcctcagcgtatcactgagcgggctggcgaggcgacagtagnnnnnnnnnn

SEQ ID NO: 42561 - DNA, 491 bp, Homo sapiens
  misc_feature: GYAE6OF02JMF4X.9.9.A09.1.454.CMB.1.raw
  modified_base (361)..(361): a, c, t, g, unknown or other
  misc_feature (361)..(361): n is a, c, g, or t
  modified_base (480)..(481): a, c, t, g, unknown or other
  misc_feature (480)..(481): n is a, c, g, or t
  modified_base (485)..(491): a, c, t, g, unknown or other
  misc_feature (485)..(491): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctcctggccatcactggcttcaggctgagatgaggctgattatactgccactcctatgacagcagcctgagaagtgtggtatcggnggaggacaagctgaccgtctaggtcagcccgaaggctcgcccccgtcggtcactctcgttcccgcccttcctcacgaccgtactcactgacgtcgggctggcgaacggcgacagtacgnngacnnnnnnn

SEQ ID NO: 42562 - DNA, 484 bp, Homo sapiens
  misc_feature: GYAE6OF02GC1S6.9.9.A09.1.454.CMB.1.raw
  modified_base (478)..(484): a, c, t, g, unknown or other
  misc_feature (478)..(484): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcgggcggagggaccaagctgaccgtctaggtcagcccaaggctcgcccctcggtccactctcgttcccaccctcctcacgacgtatcactcgagcgggctggcaaggcgcatagnnnnnnn

SEQ ID NO: 42563 - DNA, 498 bp, Homo sapiens
  misc_feature: GYAE6OF02HMID2.9.9.A09.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (417)..(417): a, c, t, g, unknown or other
  misc_feature (417)..(417): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
  modified_base (485)..(488): a, c, t, g, unknown or other
  misc_feature (485)..(488): n is a, c, g, or t
  modified_base (490)..(498): a, c, t, g, unknown or other
  misc_feature (490)..(498): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatggaggctgattattacngccagtcgtatgacagtggacctaagtaacntcgtcttcggaactgggaaccaaggtccaccgtcctgggtcacgcccaaggcccaacccnctcgtccactctcgttcccgcccttcctcacgacgtntcacgtgacgcgggctggcacggcncagtgnnnngnnnnnnnnn

SEQ ID NO: 42564 - DNA, 484 bp, Homo sapiens
  misc_feature: GYAE6OF02IC6ZS.9.9.A09.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (470)..(470): a, c, t, g, unknown or other
  misc_feature (470)..(470): n is a, c, g, or t
  modified_base (475)..(484): a, c, t, g, unknown or other
  misc_feature (475)..(484): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgacggggtccctgaccgattctctggctccaagtctggcacctcagcctccctggccatcactgggcttcaggctgaggntgagctgattatactgccactcctatgacagcagcctganagtgtggtattcgggnggaggacaagctgaccgtctaggtcacgccgaagctcgcccctgtccactctcgttcccaccctcctcacgtacgtactcactgacgcgggctggacgaggcgnatagnnnnnnnnnn

SEQ ID NO: 42565 - DNA, 483 bp, Homo sapiens
  misc_feature: GYAE6OF02HXMLY.9.9.A09.1.454.CMB.1.raw
  modified_base (367)..(367): a, c, t, g, unknown or other
  misc_feature (367)..(367): n is a, c, g, or t
  modified_base (474)..(483): a, c, t, g, unknown or other
  misc_feature (474)..(483): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcagcctccctggccatccactggcttcaggctgaggatgagctgattattactgccactcctatgacagcagcctgagaagtgtggtattcgggnggagggacaagctgaccgtctagtcagcccaagcctcgcccctgtcactctcgttcccgccctcctcacgacgtatccacgtgacgcgggctggcaggcgcagtagnnnnnnnnnn

SEQ ID NO: 42566 - DNA, 478 bp, Homo sapiens
  misc_feature: GYAE6OF02IRFJA.9.9.A09.1.454.CMB.1.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (466)..(466): a, c, t, g, unknown or other
  misc_feature (466)..(466): n is a, c, g, or t
  modified_base (470)..(474): a, c, t, g, unknown or other
  misc_feature (470)..(474): n is a, c, g, or t
  modified_base (476)..(478): a, c, t, g, unknown or other
  misc_feature (476)..(478): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatgtaatcggccctcaggggtccctgaccgattctctggctccaagtctggcacctcagcctcctggccatcactgggcttcaggctgaggatgagctgattatacngccatcctatgacagcagctganagtntggtattcggcgaggaccaagctgaccgtctaggtcagcccaaggctgcccctcggtcactctcgttcccacctcctcagacgtatccactgagcgggatcggacaaggcgacatagntagnnnnngnnn

SEQ ID NO: 42567 - DNA, 494 bp, Homo sapiens
  misc_feature: GYAE6OF02H12B4.9.9.A09.1.454.CMB.1.raw
  modified_base (337)..(337): a, c, t, g, unknown or other
  misc_feature (337)..(337): n is a, c, g, or t
  modified_base (485)..(488): a, c, t, g, unknown or other
  misc_feature (485)..(488): n is a, c, g, or t
  modified_base (492)..(494): a, c, t, g, unknown or other
  misc_feature (492)..(494): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtcccctgaccgattctctggctccaagtctggcacctcagcctccctggccatcactgggcttcaggctgaggatgaggctgattatactgccatcctatnacagcagcctgagaagtgtggtattcgggcggagggacaagctgactgtctaggtcagccgaagctgcccctcggtcactcttcgttcccgccctccctcacgtacgtactcactagaggccggcgtcggccgaaggccgcgatacgnnnngcannn

SEQ ID NO: 42568 - DNA, 525 bp, Homo sapiens
  misc_feature: GYAE6OF02JFE9E.9.9.A09.1.454.CMB.1.raw
  modified_base (517)..(525): a, c, t, g, unknown or other
  misc_feature (517)..(525): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtcccctgaccgattctctggctccaagtctggcacctcagcctccctggccatcactgggcttcaggctgaggatgaggctgattattactgccactcctaatgacagcacgctagagaagttgtggtattcgggacgggagggaccaaggctacggacccgtccgtaggtcgagtcccaaggcctacgcccccgtcggtccacttcctccgttcccgccctcctccgtacgaccgtactccacgtcgacggcggtctcgggcaacgggtcacgactagcgnnnnnnnnn

SEQ ID NO: 42569 - DNA, 490 bp, Homo sapiens
  misc_feature: GYAE6OF02I8R5N.9.9.A09.1.454.CMB.1.raw
  modified_base (480)..(480): a, c, t, g, unknown or other
  misc_feature (480)..(480): n is a, c, g, or t
  modified_base (483)..(490): a, c, t, g, unknown or other
  misc_feature (483)..(490): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgctgctcatatgcagatggtgacacgtcccgtggtattcgggcggagggaccaaggtcgaccgtctaggtcagcccaaggctcgcccctggccactctcgttcccacctcctcacgactactcactgagcgggtctcggcaaggcgacagtagngcnnnnnnnn

SEQ ID NO: 42570 - DNA, 531 bp, Homo sapiens
  misc_feature: GYAE6OF02JE2NO.9.9.A09.1.454.CMB.1.raw
  modified_base (330)..(330): a, c, t, g, unknown or other
  misc_feature (330)..(330): n is a, c, g, or t
  modified_base (524)..(524): a, c, t, g, unknown or other
  misc_feature (524)..(524): n is a, c, g, or t
  modified_base (527)..(531): a, c, t, g, unknown or other
  misc_feature (527)..(531): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaaatagtaatccggccctcgagggggtcccctgaccgattctctggctccaagtctggcacctcagcctccctggccatcactgggcttcaggctgaggatgaggctgattattacngccaactcctatgacagcagcctgagaagtgtggtattcggacggaggaccgaagctagaccgtacgtagtcacgcccgaaggctcgtaccccctggtccaccgttctccgttcccctacccgttccctaccgacgtacgttactcaacctggaacggccggcgtacggacgaacggccgactacgtagcagcngcnnnnn

SEQ ID NO: 42571 - DNA, 606 bp, Homo sapiens
  misc_feature: GYAE6OF02IW1X7.9.9.A09.1.454.CMB.1.raw
  modified_base (205)..(205): a, c, t, g, unknown or other
  misc_feature (205)..(205): n is a, c, g, or t
  modified_base (275)..(275): a, c, t, g, unknown or other
  misc_feature (275)..(275): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctnatctatggtaatagtaatcggccctcaggggtccctgaccgattctctggcctccaagtctggccacctnacgccctccctggccatccacgtgggtccttcgaggtcctggaggatggaggctagtattattacctgaccctactcctatcgacagcacgcctaggagtaagttggtagttacgtcgggacggagggaccaagcgtacgtaccgtcgtaggtcacggcccgaaggtcctccggtccccccgttcgggtcctaccgttccgttaccggttccccctacccttcccgttacgaacggtacccgttactccgtaacgtcggacgggcccggggtccgtacgggaccggtaacgggccggtacgtaacgtaggtacngtancgtgcagtcgntn

SEQ ID NO: 42572 - DNA, 493 bp, Homo sapiens
  misc_feature: GYAE6OF02IB320.9.9.A09.1.454.CMB.1.raw
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (484)..(484): a, c, t, g, unknown or other
  misc_feature (484)..(484): n is a, c, g, or t
  modified_base (486)..(493): a, c, t, g, unknown or other
  misc_feature (486)..(493): n is a, c, g, or t
tcagtgatacgtctcacgaccggtgctcgatttagcgagacgcgcagggtcctgggcccagtctgtgctgacgcagccgccctcagtgtctgggggccccaggggcagagggtcaccatctcctgcactgggagcagctccaacatcgggaatcgctatgttgtacactggtaccagcagcttccaggaacagtccccaaaccctcatctatggtaatagtaatcggcctcaggggtccctgaccgattctctggctccaagtctggcactcagcctccctggccatcactgggcttcaggctgagatgaggctgattattactgccactcctatgacancagcctgaagaagtggtggtatttcgggnggagggacaaggctgaccgtctaggtcagcccgaaggctcgccccctggtccactctcgttccccaccctcctcacgaccgtatccactgacgcgggctggcaggcgacagtgcngnnnnnnnn

SEQ ID NO: 42573 - DNA, 512 bp, Homo sapiens
  misc_feature: GYAE6OF02HKMBV.9.9.A09.1.454.CMB.1.raw
  modified_base (420)..(420): a, c, t, g, unknown or other
  misc_feature (420)..(420): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
  modified_base (507)..(508): a, c, t, g, unknown or other
  misc_feature (507)..(508): n is a, c, g, or t
  modified_base (510)..(512): a, c, t, g, unknown or other
  misc_feature (510)..(512): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcactcagcctccctggccatcactgggctttcaggctgaggatgaggctgattattactgccactcctatgacagcagcctgagaagtgtggtactcgggcggaggacgaagcgtgaccgtcctaggtcacgcccgaacggcctcgtcccccncggttccacgtcctcgttcccctcccgtaccctcaccgaacgtactcactcgcgcggcgtacggcgacggcgccgatacgnngncgnncnnn

SEQ ID NO: 42574 - DNA, 813 bp, Homo sapiens
  misc_feature: GYAE6OF02H1N31.9.9.A09.1.454.CMB.1.raw
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (801)..(801): a, c, t, g, unknown or other
  misc_feature (801)..(801): n is a, c, g, or t
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
tcagtgatacgtctcacgaccggtgctcgatttagcgagacgcgcagggtcctggggcccaggtctcgtcgcgttcgacggcagccgcccttcgagtgtctggggccccagggcagagggtcaccaatctcctgcacgtgggagcagctccaacgtatcgggaatccgtattaagtgttcgtacacgtgggtaccaggcagcttccgaggaacacgtccccgaaaccntcactctagtgggtaactaggtaatcggccctcgaggggttcccngaccgtacttctctggtcctaccctaagtctaggtccaccttcacgtccctcccgtggcccactccgacgttcgggccttacggagggcctaggaaggtaacttggaacgggtcttagggtaattttaacgttaaccgttagaccccgtaacttacccgtaaagttcgaacctaaggttaccaaacggtccccgttaaggtaacggtaaaacggggtttggggtaacggggtttaaacgtttcccggggggaacggggttaacccgggggtaaacccaaaacgggtccccgttaacgggaccccgggttttaaccgtaaacggggttacccaaaccggaaccccgtaaagggtcccgttacccggtaccccccgtttacgggtaccctaaccggttccggttccggtttaccccccggccccttacccggtaaccgtacggtaaccgttaatcccggtaaactcgggtaaccggccgggtacgttacgggccggaaacgggtccgaacgtaacgtaaggcaagtcggngagtcgngngcg

SEQ ID NO: 42575 - DNA, 486 bp, Homo sapiens
  misc_feature: GYAE6OF02GA0QQ.9.9.A09.1.454.CMB.1.raw
  modified_base (478)..(486): a, c, t, g, unknown or other
  misc_feature (478)..(486): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattatactgccactcctatgacagcagcctgagaagtgtggtattcggcggagggaccaagctgaccgtctaggtcagcccaaggcctgccccctgtccactctcgttccccgccctcctcacgacgtactccactgacgcgggctggcaaggcgcatagnnnnnnnnn

SEQ ID NO: 42576 - DNA, 499 bp, Homo sapiens
  misc_feature: GYAE6OF02H6HQA.9.9.A09.1.454.CMB.1.raw
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (489)..(490): a, c, t, g, unknown or other
  misc_feature (489)..(490): n is a, c, g, or t
  modified_base (492)..(495): a, c, t, g, unknown or other
  misc_feature (492)..(495): n is a, c, g, or t
  modified_base (497)..(499): a, c, t, g, unknown or other
  misc_feature (497)..(499): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcagcctccctgccatcactgggcttcaggctgaggntgaggctgattattacngccactcctatgacagcagcctgagaagtgtggtattcggcggaggacagctgaccgtctaggtcacgccaaggcctcgccccgtcgtccactctccgttcccgccctcctcacgtaccgtactccactggacgcgggtcgtcggcgtaagggcgacgatacgnngnnnncnnn

SEQ ID NO: 42577 - DNA, 509 bp, Homo sapiens
  misc_feature: GYAE6OF02IQ9VI.9.9.A09.1.454.CMB.1.raw
  modified_base (502)..(509): a, c, t, g, unknown or other
  misc_feature (502)..(509): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggcctcgaggggtccctgaccgattctctggctccaagtctggcacctcagcctccctggccatcactgggcttcaggctgagatgaggctgattatactgaccactctatgacagtcagcctagagaagtgtgtagtcggacggaggacaagctacgaccgtcgtagtcgacgccgaaggctccgtcccctcggtccacgtctccgttcccgccctcctcgacgtacgtactcacgtgaacggcggtcgtacggcgtaacggccggtacacgtagcannnnnnnn

SEQ ID NO: 42578 - DNA, 491 bp, Homo sapiens
  misc_feature: GYAE6OF02GMCOI.9.9.A09.1.454.CMB.1.raw
  modified_base (203)..(203): a, c, t, g, unknown or other
  misc_feature (203)..(203): n is a, c, g, or t
  modified_base (483)..(491): a, c, t, g, unknown or other
  misc_feature (483)..(491): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggacagtccccaaaccctnatctatggtaatagtaatcggccctcgaggggtccctgaccgattctctggctccaagtctggcacctcacgcctccctggccatcactgggcttcaggctgaggatgaggctgattattactgccactcctatgacagcagcctgagaagtgtggtattcgggcggagggaccagctcgaccgtcctaggtcagcccaaggctcgccccctgtcactctcgttcccaccctcctcacgtacgtatccactcggagcgggcgtggcgacggcgctatagnnnnnnnnn

SEQ ID NO: 42579 - DNA, 487 bp, Homo sapiens
  misc_feature: GYAE6OF02F2K2T.9.9.A09.1.454.CMB.1.raw
  modified_base (477)..(487): a, c, t, g, unknown or other
  misc_feature (477)..(487): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaacccctcatctatggtaatagtaatcggccctcaggggtccctgaccgattctctggttccaagtctggcacctcagcctccctggccatcactgggcttcaggctgaggatgaggctgattattactgccactcctatgacagcagcctgagaagtgtggtattcgggcggaggaccaagctgacgtcctaggtcagcccaaggcctcgcccctcggtcactctcgtcccaccctcctcacgtacgtatcactgacgcggctggcaaggcgcatagnnnnnnnnnnn

SEQ ID NO: 42580 - DNA, 515 bp, Homo sapiens
  misc_feature: GYAE6OF02I84E0.9.9.A09.1.454.CMB.1.raw
  modified_base (501)..(501): a, c, t, g, unknown or other
  misc_feature (501)..(501): n is a, c, g, or t
  modified_base (510)..(511): a, c, t, g, unknown or other
  misc_feature (510)..(511): n is a, c, g, or t
  modified_base (513)..(515): a, c, t, g, unknown or other
  misc_feature (513)..(515): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggacagtccccaaaccctcatctatggtaatagtaatcggccctcgaggggtccctgaccgattctctggctccaagtctggcacctcacgcctccctggccatcactgggcttcaggctgaggatggaggctgattattactgccactcctatcgacagcagctagagagtgtggtatcgggacggaggaccaagctgaccgtcgtaggcacgacccaaggctcgcccctggtccactctcgttccccgcctcctcgacgtacgtactaccgactcggacgccgggtctagggacaacgggccgactaaggtacgnacgtcacgnncnnn

SEQ ID NO: 42581 - DNA, 521 bp, Homo sapiens
  misc_feature: GYAE6OF02HQ4V6.9.9.A09.1.454.CMB.1.raw
  modified_base (512)..(512): a, c, t, g, unknown or other
  misc_feature (512)..(512): n is a, c, g, or t
  modified_base (515)..(521): a, c, t, g, unknown or other
  misc_feature (515)..(521): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggatcagctccaacatcgggaatcgctatgttgtacactggtaccagcagcttccaggaacagtccccaaaccctcatctatggtaatagtaatcggccctcgaggggtccctgaccgattctctggctccaagtctggcacctcagccctccctggccatcacgtgggcttcgaggctgaggatgaggctgattatactgccactcctatgacagcagctagagagtgtgtagtcggcggaggaccaagctacgaccgtcgtaggtcacgacccgaaggcctccgccccctcggtccacgtcctcgttccccaccctcctccgacgtaccgtactcctacgtgacggccgggcgtcgggaccgaacgggccgacaagtacgcnagnnnnnnn

SEQ ID NO: 42582 - DNA, 490 bp, Homo sapiens
  misc_feature: GYAE6OF02H1E8O.9.9.A09.1.454.CMB.1.raw
  modified_base (308)..(308): a, c, t, g, unknown or other
  misc_feature (308)..(308): n is a, c, g, or t
  modified_base (426)..(426): a, c, t, g, unknown or other
  misc_feature (426)..(426): n is a, c, g, or t
  modified_base (480)..(481): a, c, t, g, unknown or other
  misc_feature (480)..(481): n is a, c, g, or t
  modified_base (484)..(490): a, c, t, g, unknown or other
  misc_feature (484)..(490): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggcctcgaggggtccctgaccgattctctggctccaagtctggcacctcagcctccctggccatcactgggcttcaggctgaggntggaggctgattatactgcctactcctatgacagcagcctagagaagtggtaggtatcgggcggagggaccaagctgaccgtctagtcacgcccaagctccgcccctggtctattccncgttcccaccctcctacacgactctcactgcgcggctggacgaggcgacagtgnncgnnnnnnn

SEQ ID NO: 42583 - DNA, 493 bp, Homo sapiens
  misc_feature: GYAE6OF02IJB4E.9.9.A09.1.454.CMB.1.raw
  modified_base (308)..(308): a, c, t, g, unknown or other
  misc_feature (308)..(308): n is a, c, g, or t
  modified_base (484)..(493): a, c, t, g, unknown or other
  misc_feature (484)..(493): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggacagtccccaaaccctcatctatggtaatagtaatcggccctcaggggtccctgaccgattctctggctccaagtctggcacctcagcctccctggccatcactgggcttcgaggctggagntgaggctgattatactgccactcctatgacagcagcctgagaagtgtggtattcgggcggagggaccaagctgaccgtctaggtcagcccaaggcctcgcccctcggtccactcctcgttccccaccctcctcacgtacgtactccactggacgcgggctggcgaggcgacatcgnnnnnnnnnn

SEQ ID NO: 42584 - DNA, 518 bp, Homo sapiens
  misc_feature: GYAE6OF02F4OG3.9.9.A09.1.454.CMB.1.raw
  modified_base (214)..(214): a, c, t, g, unknown or other
  misc_feature (214)..(214): n is a, c, g, or t
  modified_base (455)..(455): a, c, t, g, unknown or other
  misc_feature (455)..(455): n is a, c, g, or t
  modified_base (503)..(504): a, c, t, g, unknown or other
  misc_feature (503)..(504): n is a, c, g, or t
  modified_base (506)..(511): a, c, t, g, unknown or other
  misc_feature (506)..(511): n is a, c, g, or t
  modified_base (513)..(515): a, c, t, g, unknown or other
  misc_feature (513)..(515): n is a, c, g, or t
  modified_base (517)..(518): a, c, t, g, unknown or other
  misc_feature (517)..(518): n is a, c, g, or t
tcagtgatacgtctcacgaccggtgctcgatttagcgagacgcgcgaagggggtcctgggcccagtctgtgctgacgcagccgccctcagtgtcgtcggggccccagggcagagggtcgaccatctccctgcacgtgggagcagcctccaacatcgggaatcgctatgttgtacactggtaccagccagcttccaggacagtccccaaaccctnatctatggtaatagtaatcggccctcgacggggtccctagaccgattcgtctggcctccaagttctaggcacctcagccctccctagaccatccagtgaattgcagactgaggatgagctaactactactgccaggtccctcgacagctagccgtgggtgtttgggtgttcgggcggagggacacgctcgaccgtctacgtcacgcccaaggcctcgcccctggtccacgtctcgttcccncctctactagtacgtactcactgacgcggctcggccaggcgacagtgnngnnnnnngnnngnn

SEQ ID NO: 42585 - DNA, 494 bp, Homo sapiens
  misc_feature: GYAE6OF02G0C3J.9.9.A09.1.454.CMB.1.raw
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
  modified_base (485)..(487): a, c, t, g, unknown or other
  misc_feature (485)..(487): n is a, c, g, or t
  modified_base (490)..(494): a, c, t, g, unknown or other
  misc_feature (490)..(494): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagccctccctggccatcacgtgggcttcaggctggaggatggaggctgatttattactgccactcctatgacagcagcctgagagtgtggtatcgggcggagggaccagctgaccgtctaggtcacgcccaggctcgcccctcggtcactcctccgttccccgccctcccagacgtactcnctacgcggcggcgtcgcgacgacggcanagnnngcnnnnn

SEQ ID NO: 42586 - DNA, 566 bp, Homo sapiens
  misc_feature: GYAE6OF02JJUE9.9.9.A09.1.454.CMB.1.raw
  modified_base (347)..(347): a, c, t, g, unknown or other
  misc_feature (347)..(347): n is a, c, g, or t
  modified_base (565)..(565): a, c, t, g, unknown or other
  misc_feature (565)..(565): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaaccctcatctatggtaatagtaatcggccctcaggggtccctgaccgattctctggctccaagtctggccacctcagccctccctggcccatccacgtgggcttcgaggctggaggatgaggctgattattactgccatcctatgacngcagcctgaagaagtgtaggtattcgggacggaggaccaagcgtcggaccgttcgtacggtcacgcccgaaggctccggcccccttgggtcctaaccttccgtccgttcccctacccttcccgtacgacgtaccgttactcctaacgttcgacgtcgggccttagggacctaaacgggccggtacctaacggttaacgcgacgtacgctagcgctcgnc

SEQ ID NO: 42587 - DNA, 505 bp, Homo sapiens
  misc_feature: GYAE6OF02HR4KV.9.9.A09.1.454.CMB.1.raw
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (504)..(505): a, c, t, g, unknown or other
  misc_feature (504)..(505): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctccctggccatccactgggcttcaggctgaggatgaggctgattattacngccactcctatgacngcagcctagagaagtgtggtattcgggcggagggaccagctgaccgtctaggtcagcccaaggctcgcccctcgtccactctccgttcccgccctcctcacgacgtactccacgtgacgtccgggcgtcggacgaacgggcacgtagtagnancngntnncnn

SEQ ID NO: 42588 - DNA, 485 bp, Homo sapiens
  misc_feature: GYAE6OF02HIG60.9.9.A09.1.454.CMB.1.raw
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
  modified_base (476)..(485): a, c, t, g, unknown or other
  misc_feature (476)..(485): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcaggggtccctgaccgattctctggctccaagtctggcacctcagccctccctggccatcactgggcttcgaggctgaggatgagctgattattacngccactcctatgacagcagcctagagagtgtggtattcggcggaggacagctgaccgtctaggtcacgcccaaggcctcgccccctcggtccactctcgttcccgccctcctcagacgtatccactgacgcgggctggcaggcgcatagnnnnnnnnnn

SEQ ID NO: 42589 - DNA, 1028 bp, Homo sapiens
  misc_feature: GYAE6OF02IW0ZC.9.9.A09.1.454.CMB.1.raw
tcagtgatacgtctcacgaccggtgctcgatttagcgagacgcgctagggttccggtgggccctaggtactgggtgctgacgcagccgcctcagtgtctggggcccctagggctaagagggtcaccgatctcctgcacgtcgggacgcgagcctaccgaacgatcgggaatcggctatgtttagtacacgtggtaccaggcgtagcttaccgaaggtaacctacgtacccccaaacccgtcacttcgtaaggtcggttaactacgtaacgtccggaccctaggaccgggtaccctacgaaccgtattccgtcgtcggtaccttaccaaagttcgtacggacctaccccgttacgaccgtccccgtacccccggtagggaccccctaacgttcccgtaaccggttacgggggttacccttttaccgggacggggttaccgttaaagggaacgggttaccgttaccgggtaaaccgggttccctttaaccgggtaaccccttttttaacggtttaacccggtttcgggttaacccccttttaacccgtttaaccccgtttaacggtttaccgggggaaccccgtaacggggtaaccccgtaacgggttaccccggttaacgggtaaaccggtttaaaccgggtttcgggtttaaccggggtttaacccgttttccccggggggaacccgggggtaaaccggggggaacccccgtaaacgggttccccgggttaacccgggttaccccccggtttaccgggttaacccgggttacccctaacccgggtaaccccccggtaaacggggtcccttacccccgggttacccccccggttccggggttaacccggtaccccgttccccggtttacccggttcccccccggtaaccccgtttcccggtacccgtaaccgggttacccgttacgtacccgtaacgtaccggtaccggtccgggttaccgtaccgggtaaccggtaccgggtcgtaaccggtaacggtcggaccgtgacgtcgacgtcgacgtgactc

SEQ ID NO: 42590 - DNA, 587 bp, Homo sapiens
  misc_feature: GYAE6OF02I8J5X.9.9.A09.1.454.CMB.1.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
  modified_base (585)..(586): a, c, t, g, unknown or other
  misc_feature (585)..(586): n is a, c, g, or t
tcagtgatacgtctcacgaccggtgctcgatttagcgagacgcgcaggggtcctgggcccagtctgtgctgacgcagccgccctcagtgtctgggccccaggcagaggtcaccatctcctgcactgggagcagctccaacatcgggaatcgctatcgttgtacactggtaccagcagcttccaggacagtccccaaaccctcatctatggtaatagtaatcggccctcaggggtccctgaccgattctctggctccaagtctgcactcagcctccngccancactggcttcagctgagntgaggctgattatactgccactcctatcgacagcagcctagacgtaaagtgtcggtagttccgggcggaagggtaccaaaggtcctggtacccggtaccgtaagggtccacggtaccccgaaagggtcctcggtcccccgttcgggttccaaccgttcgtccgtttcccccggcccgttcccgttaccgacgtaaccgttacgtaccgaccgttacggaccggccgggtaccgtgggacccgtaaccgggcccgtacgtaacaaccggtcncgtcncacgctctcnnc

SEQ ID NO: 42591 - DNA, 498 bp, Homo sapiens
  misc_feature: GYAE6OF02FREPX.9.9.A09.1.454.CMB.1.raw
  modified_base (387)..(387): a, c, t, g, unknown or other
  misc_feature (387)..(387): n is a, c, g, or t
  modified_base (485)..(487): a, c, t, g, unknown or other
  misc_feature (485)..(487): n is a, c, g, or t
  modified_base (490)..(490): a, c, t, g, unknown or other
  misc_feature (490)..(490): n is a, c, g, or t
  modified_base (492)..(498): a, c, t, g, unknown or other
  misc_feature (492)..(498): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctccggctccaagtctggcacatcagcctcctggccatcactgggctccaggctgaggatgaggctgactattactgccagtcgtatgacagtggacctaagtaacatcgtcttcggaactgggaccaggtcaccgtcngggtcagcccaaggcccaaccccactgttacaccttctcgttccccaccctcctcacgtacgtctcacgtgacgcgggctggcgaaggcacagtcgcnnncgncnnnnnnn

SEQ ID NO: 42592 - DNA, 490 bp, Homo sapiens
  misc_feature: GYAE6OF02HP2JB.9.9.A09.1.454.CMB.1.raw
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
  modified_base (369)..(369): a, c, t, g, unknown or other
  misc_feature (369)..(369): n is a, c, g, or t
  modified_base (482)..(490): a, c, t, g, unknown or other
  misc_feature (482)..(490): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaaatagtaatccggccctcgaggggtccctgaccgattctctggctccaagtctggcacctnagcctccctggccatcactgggcttcaggctgaggatgaggctgatttattactgccactcctatgacagcagcctgagagtgtgtattcgggnggaggacaagctgaccgtctaggtcagcccaaggctcgcccctggcactctcgttcccaccctcctcacgcgtactcacgtgagtcgggctcgggcaacggcgccagtacgcnnnnnnnnn

SEQ ID NO: 42593 - DNA, 575 bp, Homo sapiens
  misc_feature: GYAE6OF02IQRK4.9.9.A09.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (569)..(570): a, c, t, g, unknown or other
  misc_feature (569)..(570): n is a, c, g, or t
  modified_base (573)..(575): a, c, t, g, unknown or other
  misc_feature (573)..(575): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtcccccaaaccctcatctatggtaatagtaatccggccctcgacggggtccctgaccgatttcctctggcctccaagtctggcacctcacgccctcccctggccatccacgtcgggtccttcgaggctggaggatgaggctgattattacncgccacttcctatcgacngcagctgagtaagtgtaggtacgttcggcgggagggaccaaggcgtcgaccgtcgtaggtcacggaccgaacggcctaccgtcccccgtcggtacctacctccgtacccgttccccaccccttcccgtccgaacgtaccgtactaccaccgtggaccggtcgggaccgtacgggaccggtaacggccgacgtaagtcgagtgacgtgnncgnnn

SEQ ID NO: 42594 - DNA, 478 bp, Homo sapiens
  misc_feature: GYAE6OF02FG8EA.9.9.A09.1.454.CMB.1.raw
  modified_base (470)..(472): a, c, t, g, unknown or other
  misc_feature (470)..(472): n is a, c, g, or t
  modified_base (474)..(478): a, c, t, g, unknown or other
  misc_feature (474)..(478): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagagtgtggtatcggcggagggacaagctgaccgtctaggtcagcccaaggcctgccccctggtcactctcgttcccaccctcctcagaccgtatcactgagcgggctggcaggcgcatgnnncnnnnn

SEQ ID NO: 42595 - DNA, 507 bp, Homo sapiens
  misc_feature: GYAE6OF02HQ08F.9.9.A09.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (498)..(498): a, c, t, g, unknown or other
  misc_feature (498)..(498): n is a, c, g, or t
  modified_base (501)..(507): a, c, t, g, unknown or other
  misc_feature (501)..(507): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctnaggggtccctgaccgattctctggcctccaagtctggcacctcagcctccctggccatcactgggcttcgaggctgaggatgaggctagatttatactgccacttcctaatgacagcagcctgaagagtgtggtatcggcggaggacagcgtgaccgtctaggtcacgccaaggcctcgcccccgtgtccactcctccgttcccgcccttcctcgacgtacgtactctacgtcggacgccgggtcgcggacgacgggcgacagtagancannnnnnn

SEQ ID NO: 42596 - DNA, 570 bp, Homo sapiens
  misc_feature: GYAE6OF02G8SY5.9.9.A09.1.454.CMB.1.raw
  modified_base (204)..(204): a, c, t, g, unknown or other
  misc_feature (204)..(204): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcacggggtccctgaccgattctctggctccgaagtctggcacctcagcctcctggccatcactggcttcgaggctgaggatggaggtctgattataccgtgcctacttccgtatcgaactacgcaacgtccgtagaacgtaagtgtacggttattcgggacggaggacccaaggtcctacggtacccgtcgtaggtacacgacccgtaaggtcctacggtcccccgtaggtcctacgttccgtacggttccccgcccttccgtacgacgtaccgtactccgacgtgacgcggtcgtggacgtaacggcgtacgagtacgcgagacnctcgngtacngntcg

SEQ ID NO: 42597 - DNA, 563 bp, Homo sapiens
  misc_feature: GYAE6OF02I84C0.9.9.A09.1.454.CMB.1.raw
  modified_base (276)..(276): a, c, t, g, unknown or other
  misc_feature (276)..(276): n is a, c, g, or t
  modified_base (329)..(329): a, c, t, g, unknown or other
  misc_feature (329)..(329): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaaccctcatctatggtaatagtaatcggccctcgacggggtccctgaccgattctctggctccaagtctggcacctnacgcctccctggccatcactgggcttcaggctgaggatgaggctgattatacngccactcctatcgacagcagcctagaagtagtgtaggtacgtcgggacgggagggaccaagcgtcgaccgtcgtaggtacacggacccgaaggtcctccggcccccgttcggtaccaccgttccttccgttcccctaccccgttccctaccgtaacgtaccttacgtcctacgtcggacggcgggtcgtacgggacgtacgggccgtacgtacgtagctagcgactgncatcgn

SEQ ID NO: 42598 - DNA, 499 bp, Homo sapiens
  misc_feature: GYAE6OF02IHIT3.9.9.A09.1.454.CMB.1.raw
  modified_base (344)..(344): a, c, t, g, unknown or other
  misc_feature (344)..(344): n is a, c, g, or t
  modified_base (484)..(484): a, c, t, g, unknown or other
  misc_feature (484)..(484): n is a, c, g, or t
  modified_base (490)..(499): a, c, t, g, unknown or other
  misc_feature (490)..(499): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcgaggggtccctgaccgattctctggctccaagtctggcacctcagccctcctggccatcactgggcttcgaggctgaggatggaggctgattatactgccactcctatcgacngcagctagagaagtgtggtattcgggacggaggaccaagctgaccgtccgtaggtcacgacccaaggctcgcccctcggtccactcctcgtccccacctcctcacgtacgtactcgactgacggcggcgtggacgaggcncatagnnnnnnnnnn

SEQ ID NO: 42599 - DNA, 504 bp, Homo sapiens
  misc_feature: GYAE6OF02GFK7U.9.9.A09.1.454.CMB.1.raw
  modified_base (495)..(504): a, c, t, g, unknown or other
  misc_feature (495)..(504): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagccctccctggccatccacgtgggcttcaggctgaggatggaggctgtattattactgccactcctatgacagcagcctgagagtgtggtattcgggcggagggacaagctagaccgtctaggtcagcccaaggcctcgccccctggtccaccgtctccgttccccacccttcctacacgtacctatccactgacgcgggctcggcgaaggcgacagtagnnnnnnnnnn

SEQ ID NO: 42600 - DNA, 511 bp, Homo sapiens
  misc_feature: GYAE6OF02I7JK2.9.9.A09.1.454.CMB.1.raw
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (502)..(503): a, c, t, g, unknown or other
  misc_feature (502)..(503): n is a, c, g, or t
  modified_base (505)..(511): a, c, t, g, unknown or other
  misc_feature (505)..(511): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaacccctcatctatggtaatagtaatcggccctcgacggggtccctgaccgattctctggctccaagtctggcacctcacgccctccctggccatcacgtgggccttcgaggctggaggatggaggctgtattattactgccctacttcctatcgacagcagcctgagaagtgtggtagtcgggcggaggacagctcgaccgtcgtagtcacgaccaacggcctccgcccctcgtccnctcctccgtccccncctccncgacgtacgtactcacgtcgcggcggcgcggcgacggcgacagtgnncnnnnnnn

SEQ ID NO: 42601 - DNA, 540 bp, Homo sapiens
  misc_feature: GYAE6OF02GKUYL.9.9.A09.1.454.CMB.1.raw
  modified_base (334)..(334): a, c, t, g, unknown or other
  misc_feature (334)..(334): n is a, c, g, or t
  modified_base (529)..(529): a, c, t, g, unknown or other
  misc_feature (529)..(529): n is a, c, g, or t
  modified_base (534)..(540): a, c, t, g, unknown or other
  misc_feature (534)..(540): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtcccctgaccgtattctcgtggctccaagtctggcacctcagccctcctggccaatcacgtgggcttcgaggctggaggtatgaggctgattattacngccactcctatcgaacagcagcctagaagagttgtggtacgttcgggacggaggaccagctacggaccgttcaggtcacgcccgaaggcctcgcccctcggtccacttcctacgttccccaccctcctacgacgtacgtactacctacgtcggacgtccggggtcgtcgggtacgaacggcggacctaagtagangacgnnnnnnn

SEQ ID NO: 42602 - DNA, 588 bp, Homo sapiens
  misc_feature: GYAE6OF02FHSHX.9.9.A09.1.454.CMB.1.raw
  modified_base (206)..(206): a, c, t, g, unknown or other
  misc_feature (206)..(206): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (577)..(577): a, c, t, g, unknown or other
  misc_feature (577)..(577): n is a, c, g, or t
  modified_base (579)..(582): a, c, t, g, unknown or other
  misc_feature (579)..(582): n is a, c, g, or t
  modified_base (584)..(588): a, c, t, g, unknown or other
  misc_feature (584)..(588): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaccacgtccccaaacccctnatcctatcggtaatagtaactccgggcccctacgacgggggttcccctggacccgtatttcctcgtggccttcccaagttcctggccacccttcacgcccctcccccgggcacgttccacgttgggcttcaggtctgaggatggacggtctaggtattacttaccngccctacttcctatcgacngccagcctgagtaagttgtggtactcgggcggaggaccagctcgaccgtccgtaggtccacgcccaacggcctaccgtccccctcggtcctaccgttcctccgtccccacccttcccgtccaacgtaccgtacgtccgtacgtcgacggtccgggcgtcggaccgaacggccgaacgtatacggcncnnnncnnnnn

SEQ ID NO: 42603 - DNA, 480 bp, Homo sapiens
  misc_feature: GYAE6OF02JDJAM.9.9.A09.1.454.CMB.1.raw
  modified_base (456)..(456): a, c, t, g, unknown or other
  misc_feature (456)..(456): n is a, c, g, or t
  modified_base (471)..(480): a, c, t, g, unknown or other
  misc_feature (471)..(480): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtcccctgaccgattctctggctccaagtctggcacctcacgcctcctggccatcactgggcttcaggctgaggatgaggctgattatactgccactcctatgacagcagctgagagtgtggtatcggcggaggaccagctgaccgtctaggtcacgcccaaggcctcgccccgtggtccacttctcgttcccgcctcctcacgacgtatcactgagcggcnggacaggcgcagtgnnnnnnnnnn

SEQ ID NO: 42604 - DNA, 605 bp, Homo sapiens
  misc_feature: GYAE6OF02H61SN.9.9.A09.1.454.CMB.1.raw
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (549)..(549): a, c, t, g, unknown or other
  misc_feature (549)..(549): n is a, c, g, or t
  modified_base (592)..(592): a, c, t, g, unknown or other
  misc_feature (592)..(592): n is a, c, g, or t
  modified_base (600)..(601): a, c, t, g, unknown or other
  misc_feature (600)..(601): n is a, c, g, or t
  modified_base (603)..(605): a, c, t, g, unknown or other
  misc_feature (603)..(605): n is a, c, g, or t
tcagtgatacgtctcacgaccggtgctcgatttagcgagacgcgcagggtcctgggcccagtctgtgctgacgcagccgccctcagtgtctgggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcacctcacgccctccctggcccatccgacttgggccttcgaggctggagatgacggctgattacttacncgccactcctatcgacngcagcctagagtagtggtacgtagttcgggngggtaagggaccaaggcgtacgacccggttcctaggtccacgtacccgaaggtcccttaccggtcccccgtcggttcctaccgttcccgttccgtttcccccgccccttacccgtacgaaccggtaccgttacttaccgacgttacggaccgggcccggggttntaccggggtaaccgaacggggtccgaaccgtaagttacgggcncgcgatcnncnnn

SEQ ID NO: 42605 - DNA, 504 bp, Homo sapiens
  misc_feature: GYAE6OF02G9V7B.9.9.A09.1.454.CMB.1.raw
  modified_base (371)..(371): a, c, t, g, unknown or other
  misc_feature (371)..(371): n is a, c, g, or t
  modified_base (494)..(495): a, c, t, g, unknown or other
  misc_feature (494)..(495): n is a, c, g, or t
  modified_base (497)..(497): a, c, t, g, unknown or other
  misc_feature (497)..(497): n is a, c, g, or t
  modified_base (499)..(504): a, c, t, g, unknown or other
  misc_feature (499)..(504): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaacccctcatctatggtaatagtaatcggccctcaggggtccctgaccgattctctggctccaagtctggcacctcagcctccctggccatcactgggcttcaggctgaggatgaggctgattattactgccactcctatgacagcatcctagagtaagtgtggtattcgggnggacgggacaagctgaccgtcctaggtcacgcccaaggcctcgcccccgtcggtccaccgtctcgttcccaccctcctcacgacgtactcactcgagccgggcgtggcgaaggcgacagtagnncngnnnnnn

SEQ ID NO: 42606 - DNA, 725 bp, Homo sapiens
  misc_feature: GYAE6OF02IO6VI.9.9.A09.1.454.CMB.1.raw
  modified_base (220)..(220): a, c, t, g, unknown or other
  misc_feature (220)..(220): n is a, c, g, or t
  modified_base (704)..(704): a, c, t, g, unknown or other
  misc_feature (704)..(704): n is a, c, g, or t
  modified_base (713)..(713): a, c, t, g, unknown or other
  misc_feature (713)..(713): n is a, c, g, or t
  modified_base (716)..(716): a, c, t, g, unknown or other
  misc_feature (716)..(716): n is a, c, g, or t
  modified_base (721)..(721): a, c, t, g, unknown or other
  misc_feature (721)..(721): n is a, c, g, or t
tcagtgatacgtctcacgaccggtgctcgatttagcgagacgcgctagggttcctcggcccagtctgtgctgacgccagccgccgtcagtcgtcgtggggccccagggcagagggtcaccgactctcctggcaacgtcgggagcacgctccaacactcgggatcgctatgttgtacactggtaccagcagtctttccaggacgacgtccccgaaaccctnaatctacgtgggtaaatagttaacgtcggtaccctgtacggggtccctgtacccgtattcctcgtggctaccgtaagtcctcggctacctcacgccctacccgtggccctagttccacgttgggtaccttccgacggtcgtagacggacttggacggtcttagttaacttttacgttacgtacgtcctaacttccttaacgtcggaaccgacggacctacgtaccgttaggaacggtaacgttttgggttacggttacggttcgggacgggtaacgggaaccgaacggtcgtacggtaccgttcgttaacggttacgtacgtacccgtaacggtcccgtaccgtaccccgttacgtaccgtaccgtcccggtaccgttccccgtcccgtacccgtaccgtaaccggtaaccgttacgttccgtaccgtcggtccggtccggtacgttccggaccgtacgggaccgaccgtacgtacgacgtccncgaccgtcnccnctacngtac

SEQ ID NO: 42607 - DNA, 587 bp, Homo sapiens
  misc_feature: GYAE6OF02IY4SJ.9.9.A09.1.454.CMB.1.raw
  modified_base (209)..(209): a, c, t, g, unknown or other
  misc_feature (209)..(209): n is a, c, g, or t
  modified_base (333)..(333): a, c, t, g, unknown or other
  misc_feature (333)..(333): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(585): a, c, t, g, unknown or other
  misc_feature (584)..(585): n is a, c, g, or t
  modified_base (587)..(587): a, c, t, g, unknown or other
  misc_feature (587)..(587): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaaccacgtacccccaaacccctnatctataggtaatagtaactccgccctcgacgggtccctgaccgattctcgtggcctccaagtctcggccacctcacgccccttcccgtggcccactcacgtcgggtcttcgaggtctaggagngtgaggctagtattattactcgcctactcctagtcgacagacacgtccgtagacgtagtggtaggtacgtcgggacgggacggaaccgagtcgtacgtacgtaccgtacgcacggccgaacggtcctccgtccccgtcggtacctacgttccgttccgttcccgtccctaccgttaccgacgtacctacgtccgactacggacggtccgggtacgtcggtacgacgggccgacgtagcgagtnacngnncnntn

SEQ ID NO: 42608 - DNA, 564 bp, Homo sapiens
  misc_feature: GYAE6OF02IAJR6.9.9.A09.1.454.CMB.1.raw
  modified_base (369)..(369): a, c, t, g, unknown or other
  misc_feature (369)..(369): n is a, c, g, or t
  modified_base (548)..(548): a, c, t, g, unknown or other
  misc_feature (548)..(548): n is a, c, g, or t
  modified_base (554)..(556): a, c, t, g, unknown or other
  misc_feature (554)..(556): n is a, c, g, or t
  modified_base (563)..(563): a, c, t, g, unknown or other
  misc_feature (563)..(563): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaaccctcatctatggtaatagtaatcggccctcgacggggtccctgacccgtattcctctcggctccgaaagttctggccacctcacgccctccctggcctatcacttggggcctttcgaggctaggaggactggaggcttgaatttattactcgccactcctatcgacngcagcctgagaagtgtggtattcgggcggagggacaacgctcggaccgtctaggtcacgccgaaggcctccgtccccgtcggcctacgttcctcgttcccaccccttcctaccacgtaccgtactaccgtacgtcggacggtccgggtacgtacgggacaacgggcgacgtaagtacgngagtgnnngtcacgna

SEQ ID NO: 42609 - DNA, 655 bp, Homo sapiens
  misc_feature: GYAE6OF02H4DP9.9.9.A09.1.454.CMB.1.raw
  modified_base (363)..(363): a, c, t, g, unknown or other
  misc_feature (363)..(363): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctcatctataggtaatagtaatcggccctacgacggggtccctagacccgtatttcctcgtcggctcccaaggttcctggccacctcacgcctccccgtggcccatcactgggcttcgaggctgagatggagctgattatactcgccacttcctatcgacngcagcctgacgtaagtggtaggtagttcgggacggaacgggacgaacggcgtcgaccggtccgtacggtacgaaccggtccgaacgggcctccggtaccccccgttacgggtaccctaaccgttccgtacccgtttccccggtcccccgttacccgttaccgtaaccggtacccgttaaccgttacccgtaccgtacgggtaccgggtcccgggtaccggttccggggacccggtaaccgggcccggtaccgtaacggtaacggtactcggccgtcgacgtgctccgagtcg

SEQ ID NO: 42610 - DNA, 496 bp, Homo sapiens
  misc_feature: GYAE6OF02GMI9I.9.9.A09.1.454.CMB.1.raw
  modified_base (482)..(482): a, c, t, g, unknown or other
  misc_feature (482)..(482): n is a, c, g, or t
  modified_base (488)..(496): a, c, t, g, unknown or other
  misc_feature (488)..(496): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctccctggccatcactgggcttcaggctgaggatgaggctgattatactgccactcctatgacagcagcctgagaagtgtggtattcgggcggagggaccaagctacgaccgtccgtaggtcacgcccaaggtctcgtccccgtcggtcactctcgttccccgccctcctcagacgtatccgactggagcgggctggacgaggcgnagtagnnnnnnnnn

SEQ ID NO: 42611 - DNA, 540 bp, Homo sapiens
  misc_feature: GYAE6OF02H7I6S.9.9.A09.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (535)..(540): a, c, t, g, unknown or other
  misc_feature (535)..(540): n is a, c, g, or t
tcagtgatacgtctcacgaccggtgctcgatttagcgagacgcgcagggtcctgggcccaggtctgtgctgacgcagccgccctcagtgtctggggccccaggggccaggagggtcaccgatcctcctgcactgggagcaggcctccaacatacgggaatcggactatgttgtacactggtaccagcagcttcagacagtccccaaacctcatctatgtaatagtaatcggaccctgacgggtccctggacccgattccnttcggctaccaagtctggcacctcagcctcctggccatcactggcttcgagctgngatgaggctgattatactncacttccaatgacngcngctgaanaagtgtaggtattcgggaggtagggacaaggcgtagaccgtcgtacggtcacggcccaaggcctacggccccctgggtaccctactcctccgttcccgtcccgtccctaccgaccgtactacgttcacgtgacggtcggcgtacgggccgtaacggcgacgtacncggaacngncgnnnnnn

SEQ ID NO: 42612 - DNA, 581 bp, Homo sapiens
  misc_feature: GYAE6OF02FW3B8.9.9.A09.1.454.CMB.1.raw
  modified_base (202)..(202): a, c, t, g, unknown or other
  misc_feature (202)..(202): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (578)..(581): a, c, t, g, unknown or other
  misc_feature (578)..(581): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccagacagtccccaaaccctnatctatggtaatagtaatccggcccttcgacggggttccctagaccgtattctccgtggcctccaagtctcggccacctcacggcccctccgtggccctatccacgtgggccttcgagggctggaggatggaggtctgatttactctgaccctactctaatgacagcagctaggagagttggtaggttactcgggcggaggaccagtctacggaccgtccgtaggtccgacgcccgaacggtcctaccggcccccgttcggtacctaccgtccgttaccgttccccgtcccttcctcgaccgtaccgttactccgtaacgtcggacggccggtcgtacgggacgacgggccgacgtacgtacgntagcngtncgtnnnn

SEQ ID NO: 42613 - DNA, 531 bp, Homo sapiens
  misc_feature: GYAE6OF02GTSJR.9.9.A09.1.454.CMB.1.raw
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(531): a, c, t, g, unknown or other
  misc_feature (526)..(531): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcacggggtccctgaccgattctctggctccaagtctggcacctcagcctccctggcccatcactgggcttcgaggctggaggatggaggctgtattattactgcctactcctatgacagcagcctagagagtgtggtatcgggcggaggacagcgtcgaccgtcgtaggtcacgacccgaaggcctcgcccccgtcggtccacttcctccgttccccacccttccctaccgacgtaccgtactccgacgttcggacggccggtcgtggaccgaacggccggactacgtagcngcncnnnnnn

SEQ ID NO: 42614 - DNA, 490 bp, Homo sapiens
  misc_feature: GYAE6OF02H4X70.9.9.A09.1.454.CMB.1.raw
  modified_base (407)..(407): a, c, t, g, unknown or other
  misc_feature (407)..(407): n is a, c, g, or t
  modified_base (477)..(477): a, c, t, g, unknown or other
  misc_feature (477)..(477): n is a, c, g, or t
  modified_base (479)..(480): a, c, t, g, unknown or other
  misc_feature (479)..(480): n is a, c, g, or t
  modified_base (482)..(490): a, c, t, g, unknown or other
  misc_feature (482)..(490): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaaacatcgggaatcgctatgttgtacactggtaccagcagcttccaggaacagtccccaaaaccctcatctatggtaatagtaatcggccctcaggggtccctgaccgattctctggctccaagtctggcacctcagcctcctggccatcactggcttcgagctgagatgagctagtattatactgcctagtcgtatgacagtgacctaaagtacatcgtcttggaactgggaccaggtcaccgtctggtcacgccaaggccaacccnctgtcactctacgttcccacctcctcacgtacgtactcacgtcgacgcggctaggcaacggcgacagtgntnncnnnnnnnnn

SEQ ID NO: 42615 - DNA, 679 bp, Homo sapiens
  misc_feature: GYAE6OF02JTZ3B.9.9.A09.1.454.CMB.1.raw
  modified_base (203)..(203): a, c, t, g, unknown or other
  misc_feature (203)..(203): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagactccaacatcgggaatcgctatgttgtacactggtaccagcagcttccaggacagtcccaaaccctnatctatggtaatagtaatcggccctcgaggggtccctgaccgtattcctctcggctccaagtctggcacctcacgcctcctggccatcacgtgggcttcgaggctgaggatgacggctgattattactgcctactcctatgtaccagcaacgtcctaggaagtaacgttgttacggtaacgtttcgggacgggaagggacctaaggccgttaggtaacccgttccgttaagggtacccaacgggtaccccgaaacggtccgttaaccggtccccccgttacgggtaccctaaccgtttccttacccggtttacccccacccctttaccgtaccgtaaccggtaccgttaacctaccgtaacggttacggaaccgggtccggggtacgttaccggggaccgtaacgggggtacccgtacgttaacggttaaccggtacgtaccgtacgttacgaccgtacgtacgtacgtacgtacg

SEQ ID NO: 42616 - DNA, 571 bp, Homo sapiens
  misc_feature: GYAE6OF02JEP0N.9.9.A09.1.454.CMB.1.raw
  modified_base (473)..(473): a, c, t, g, unknown or other
  misc_feature (473)..(473): n is a, c, g, or t
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
  modified_base (559)..(560): a, c, t, g, unknown or other
  misc_feature (559)..(560): n is a, c, g, or t
  modified_base (563)..(564): a, c, t, g, unknown or other
  misc_feature (563)..(564): n is a, c, g, or t
  modified_base (567)..(571): a, c, t, g, unknown or other
  misc_feature (567)..(571): n is a, c, g, or t
tcagtgatacgtctcacgaccggtgctcgatttagcgagacgcgcagggtcctgggcccagtctgtgctgacgcagccgccctcagtgtctcggggccccagggcagagggtcaccatctcctgcactgggagcagctccaacatcgggaatcgctatgttgtacactggtaccagcagcttccaggaacacgtaccccaaaccctcatctatggtaatagtaactccggccctcgacggggtccctgaccgtattccccctgtcggcctaccgaagtccgtcggccacctcacgccctcccgtggccaatccacgtgggtccttcgaggtctggaggatggagtctgtacttattacgcgaccacttctatcgacagcacgctaggacgtaagtgtcggtacgtcgggcggaggacacgtcgtagaccgttaccgtaggcacgacccgaggcctccggcccctacggtaccncttcgtccgtcccctacccgtcctacgacgtactacgtcaaccgtggaccgngggttacncgggaccgacggtccgacagtacggnngcnncgnnnnn

SEQ ID NO: 42617 - DNA, 696 bp, Homo sapiens
  misc_feature: GYAE6OF02JZTDD.9.9.A09.1.454.CMB.1.raw
  modified_base (150)..(150): a, c, t, g, unknown or other
  misc_feature (150)..(150): n is a, c, g, or t
  modified_base (162)..(162): a, c, t, g, unknown or other
  misc_feature (162)..(162): n is a, c, g, or t
  modified_base (199)..(199): a, c, t, g, unknown or other
  misc_feature (199)..(199): n is a, c, g, or t
  modified_base (398)..(398): a, c, t, g, unknown or other
  misc_feature (398)..(398): n is a, c, g, or t
  modified_base (672)..(672): a, c, t, g, unknown or other
  misc_feature (672)..(672): n is a, c, g, or t
  modified_base (689)..(689): a, c, t, g, unknown or other
  misc_feature (689)..(689): n is a, c, g, or t
  modified_base (696)..(696): a, c, t, g, unknown or other
  misc_feature (696)..(696): n is a, c, g, or t
tcagtgatacgtctcacgaccggtgctcgatttagcgagacgcgcagggtcctgggcccagtctgtgctgacgcagccgcctcacgtgtctggggccccagggccagaggtcaccatctcctgcactggagcagctcacatcggaatcgntactgttgtacnctggtaccagcagcttccaggacacgtcccaaacctnatctataggtaatagtaatcggcctgacggggtccctagacccgtattcctctggacctcgaattcgtagccaccgtcgaccgccctaccggtcggaccaagtccgaacgtcgggcttccgaggcttggaacggtactggaacggtctaagggtacttacgttacgcgtacccagttacccttaaactcgggtaaaccnggtacccgtacggtacccgttaggaaaccgtaagggtttcgttacggggtaacctttcgggggaaccgggtacggtaacgaacggtacgtacgtacccgtacggttacggaaccgtcggacccgtaaacgggtcctacccggttaccccggtccggttaaccgtaccttcggttcccggtaacccgttccgttaccccgtgaaacccgttcggtacttcccgtaccgttacggaaaccgtcggttccgcggacgtaccggtacgacacggttanacggactcgtcagtcgntgaccgn

SEQ ID NO: 42618 - DNA, 573 bp, Homo sapiens
  misc_feature: GYAE6OF02FZFTX.9.9.A09.1.454.CMB.1.raw
  modified_base (332)..(332): a, c, t, g, unknown or other
  misc_feature (332)..(332): n is a, c, g, or t
  modified_base (564)..(564): a, c, t, g, unknown or other
  misc_feature (564)..(564): n is a, c, g, or t
  modified_base (567)..(573): a, c, t, g, unknown or other
  misc_feature (567)..(573): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaaccctcatctatggtaaatagtaatccggccctcgacggggtccctgaccgattctctggctccaagtctggcacctcagccctcctggccatcactgggcttcaggctgaggatgaggctgtattattacncgacctactcttatcactagcaacgcctggaagtaacgtggttaggtagttcgggacggtagggaaccgaagctcgaccgttccgtaggtaccacgacccgaacggcctaccggcccccgttcggtaccaccgttccgttaccgttccccgtcccctccgtaccgacgtacgtacttccaacgtggaacggtccgggcgtacggtaccgaagggcgacgtaagtacgcgtancgnnnnnnn

SEQ ID NO: 42619 - DNA, 645 bp, Homo sapiens
  misc_feature: GYAE6OF02FSO9U.9.9.A09.1.454.CMB.1.raw
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (640)..(643): a, c, t, g, unknown or other
  misc_feature (640)..(643): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctcatctatggtaatagtaactccggccctcgacggggtccctgaccgtattctctggcctccaagtctggcacctcacgccctccctggccctatccgacgtcggggtccttcgacggtcctgggcggatggaggtcttagtatttagttactcgaccctacttccgtatcgacacgtccacgtcctaggaacgtaagttggtacggttacgttcgggacgggtacgggaaccgtaacggtcgtacggtacccgttccgtacggtcgaccggacccgaagtccgtcccgtcccccgttccggtcctacccgttccgttcccggttcccccgtccccgttaccctaccgtaaccgtaaccgttaaccttccgtaacgtcggaccgggtccgggtccgtacgggaccgaacggggtccctacgtaacgtgctgcngngnnnngc

SEQ ID NO: 42620 - DNA, 548 bp, Homo sapiens
  misc_feature: GYAE6OF02IWL79.9.9.A09.1.454.CMB.1.raw
  modified_base (204)..(204): a, c, t, g, unknown or other
  misc_feature (204)..(204): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
  modified_base (541)..(542): a, c, t, g, unknown or other
  misc_feature (541)..(542): n is a, c, g, or t
  modified_base (545)..(548): a, c, t, g, unknown or other
  misc_feature (545)..(548): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttcaggaacagtccccaaacccctnatctatggtaatagtaatcggcccctcgaggggtcccctgaccgattctctggctccgaagtctggccacctcagcccctcctggccatcacgtcgggccttcgaggtcctggaaggtactggacggcttgtaatttattaccgtgccctacttccctatcgacagtcagcctagacgtaaggtcgtaggtacttcgggacggagggaccaagcacggtaccgtctagtcacgcccgaacgctacgcccccgtgtccacttcctccgttcccaccttcccacgacgaccgtntccgactcggacgccgggntacggcacgggntacaagtnactgcnncannnn

SEQ ID NO: 42621 - DNA, 578 bp, Homo sapiens
  misc_feature: GYAE6OF02GAPW1.9.9.A09.1.454.CMB.1.raw
  modified_base (204)..(204): a, c, t, g, unknown or other
  misc_feature (204)..(204): n is a, c, g, or t
  modified_base (338)..(338): a, c, t, g, unknown or other
  misc_feature (338)..(338): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (562)..(565): a, c, t, g, unknown or other
  misc_feature (562)..(565): n is a, c, g, or t
  modified_base (568)..(578): a, c, t, g, unknown or other
  misc_feature (568)..(578): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaatagtaatcggccctcaggggtccctgaccgattctctggcctccaagtctggcacctcacgcctccctgacccatcctctgggctccaggctggaggacgaggctgattattctgcagctaanaaaaagtagtacgcccttacgtcggttgggttttccgggacggggggtaaccgaagggtcggaacccgttacgtaacggtcgacgacccgtaaagggtccgtaccgccccccgttgggtaccctaccgttaccgtccggtttacccccacccgtacctccgaacgtaccgttactcctaacgttgacggcgggtctacgggcgaacggcgactagacgnacngnnnngtnnnnnnnnnnn

SEQ ID NO: 42622 - DNA, 564 bp, Homo sapiens
  misc_feature: GYAE6OF02HHS15.9.9.A09.1.454.CMB.1.raw
  modified_base (206)..(206): a, c, t, g, unknown or other
  misc_feature (206)..(206): n is a, c, g, or t
  modified_base (514)..(514): a, c, t, g, unknown or other
  misc_feature (514)..(514): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (559)..(560): a, c, t, g, unknown or other
  misc_feature (559)..(560): n is a, c, g, or t
  modified_base (562)..(564): a, c, t, g, unknown or other
  misc_feature (562)..(564): n is a, c, g, or t
tcagtgatacgtctcacgaccggtgctcgatttagcgagacgcgcagggtcctgggcccagtctgtgctgacgcagccgccctcagtgtctggggccccagggcaggagggtcaccatctcctgcactgggagcagctccaacatcgggaatcgctatgttgtacactggtaccagcagcttccaggaacacgtccccaaaccctnatctatggtaatagtaatccggccctcgacggggtccctgaccgtattctcgtggcctccaagtctcggcacctcacgtccctcccgtggccatccacgttcgggactttcgaggtctaggacggagtggagctagtattaacttacgtcgacctaccttcctaatgacctaggcacgcctaggaacgtaagttggtacgtagttccgggacggtacggacagcgtacgaccgtcgtaggtcacgccgaagccgtccgcccctgtcctacgtctccgttaccccgcccttaccacgtacgacgttacncgacgtgacggcggtcgcggtacgacggcacgtactgtncgncanncnnn

SEQ ID NO: 42623 - DNA, 601 bp, Homo sapiens
  misc_feature: GYAE6OF02JMSKK.9.9.A09.1.454.CMB.1.raw
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (592)..(593): a, c, t, g, unknown or other
  misc_feature (592)..(593): n is a, c, g, or t
  modified_base (599)..(599): a, c, t, g, unknown or other
  misc_feature (599)..(599): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacatcgggaatcgctatgttgtacactggtaccagcagcttccaggaacacgtccccaaaccctcatctatggtaatagtaatccggcctcgagggtccctgaccgatctactggcctccaagtctcggacacctcagccctcctggccatcacgtgggccttnaggctagagatggagctgattatacngcctactccatcgacagtacagcctgaataaggtgttaggtacgttcgggacgggtacggaaccgtaagtcgtagacgtcgtacgtacggtacgacgtcccgaacggtccgtaccgccccgtccgggtctaaccgttccgttccgttccccggtcccttcccggtacctaacggtaccgttaacgttaccgacgttacgaccgggttcccgggactttacgggaccgtaacggtacgtacgaacgttacgacgcgttcggnngcgcgntg

SEQ ID NO: 42624 - DNA, 531 bp, Homo sapiens
  misc_feature: GYAE6OF02F49GG.9.9.A09.1.454.CMB.1.raw
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(531): a, c, t, g, unknown or other
  misc_feature (526)..(531): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagccctcctggccatcacgtgggcttcgaggctgaggatgagctgtattagttactcgaccactcctatgacagcagcctagagtaagtggtggtactcgggacgggaggaccaagcgtcgaccgtcgtacggacgacgacccgaggcctcgccccgtcggtcctccgtccgtccgttccccgtccctcctcgtacgacgtactacgacgtcggacggcgggctacggcgaacggcgactacgtagntancncnnnnnn

SEQ ID NO: 42625 - DNA, 677 bp, Homo sapiens
  misc_feature: GYAE6OF02I767O.9.9.A09.1.454.CMB.1.raw
  modified_base (213)..(213): a, c, t, g, unknown or other
  misc_feature (213)..(213): n is a, c, g, or t
  modified_base (665)..(665): a, c, t, g, unknown or other
  misc_feature (665)..(665): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
tcagtgatacgtctcacgaccggtgctcgatttagcgagacgcgcagggtcctgggcccagtctgtgctgacgcagccgccctcagtgtctcggggccccagggcaggagggtcaccatctcctgcactggaaccagcagtgacattggtgcttataactatgtctcctggtaccaacagcaccaggcaaacgtccccaaactcatgatttangaggtcaataagccggccctcgtcggggtccctgactcgtccttctcgtggcctaccaacgttctcggaccaaccgacccggtccctcccgtcgacccgtctcgtcgggcctccgagggctacggacgtagtcggacggctagtaattacttacgtgccagtctacgtaatactggaccgacggcccaaacccgaataagttcggttaccggtacgggaacggtccgggacccgtacgggtacccaacccggttaccgtagggacccgtaacgaccccggtaaccggaccccaaccccgtcgttccgtacctaacccggttcccttcccgttaccccccaacccgtttccctaacgtaaccggtaccttacgtcctaacggtcgacgggacccgggtagtaccgggaaccgtcgggacggacttaacgacggtccacgtgacgatcgacgtntaacgngtancg

SEQ ID NO: 42626 - DNA, 680 bp, Homo sapiens
  misc_feature: GYAE6OF02IM5M0.9.9.A09.1.454.CMB.1.raw
  modified_base (426)..(426): a, c, t, g, unknown or other
  misc_feature (426)..(426): n is a, c, g, or t
  modified_base (674)..(674): a, c, t, g, unknown or other
  misc_feature (674)..(674): n is a, c, g, or t
  modified_base (676)..(680): a, c, t, g, unknown or other
  misc_feature (676)..(680): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagtctccagaacacgtaccccaaaccctcaatctatggtaatagtaactcggaccctggacggggtccctagaccgtattcgtcgtaggcctaccgaagtcgtcggaccacccgttcaaccggtccctccccgtgggacccagttcctaccgtgggtcctttacgaggtcctaggaaggtactgggtaacggtcttaagttaacgttttacttacgtcgtacccaacgtttaccctaagtcgaaccgganacccgtacgtaccgtggtaaacggtaagttcgggttaaacgttcgggtttaccgggacgggaacggtaccgaagtccggttacgacccgtcgtaacggtacgacgaccgacggtccgttcccggtccccgtccgtcctccgtaccgttcccgtaccccctacccgttccacgtaacgtacgtaactacgtaccgtggaccggtcggttacggcgtaacggtaccggacgacgtactaagcgctacgancnnnnn

SEQ ID NO: 42627 - DNA, 569 bp, Homo sapiens
  misc_feature: GYAE6OF02I5CVV.9.9.A09.1.454.CMB.1.raw
  modified_base (273)..(273): a, c, t, g, unknown or other
  misc_feature (273)..(273): n is a, c, g, or t
  modified_base (561)..(561): a, c, t, g, unknown or other
  misc_feature (561)..(561): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgacggggtccctgaccgattctctggctcaagtctggcacctnacgccctcctgccatcacgtcggcttcgagctgaggatgaggctgattattctgaccactcctatgacagcagcctgagaagtggtagtgtcggaggtaggaccaagtctaggacccgttacgtacggtaccgacgacccgaacggtccgttacccgcccccgttcggtaccctccgtccttcccggttcccctaacccttcccgtacctacgtaaccctacttaccgaccgtacggacgggtcggtcgtacgggtacgaacgggcgtccaacgttacgcgatgcgangctcatcg

SEQ ID NO: 42628 - DNA, 720 bp, Homo sapiens
  misc_feature: GYAE6OF02IXSPE.9.9.A09.1.454.CMB.1.raw
  modified_base (710)..(710): a, c, t, g, unknown or other
  misc_feature (710)..(710): n is a, c, g, or t
  modified_base (717)..(717): a, c, t, g, unknown or other
  misc_feature (717)..(717): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggatcgctatgttgtacactggtaccagcagcttccaggaacacgtccccaaacccctcatctatggtaatagtaatcggccctcgacggggtccctgaccgtattcctcgtcggcctaccaagtccgtggcctaccctcgacgtccctcccgtcggccatccacgtcgggcttcgacggctggacggtatcggaggtctggtaacttttacttacgtcggtaccctaacttccctaagtcgaacacgactacggccgtagaaggtaaggttgggtacgggttacgtttcgggggaccggggaacggggtaacccgaaaggtcccggttacggtaacccgggttacccgttaacggggtaccgaaccggaccccgtaaacgggtcccgttacccggccccccgtttaccgggtacccttaacccgttcccgtttcccggtttaccccccgtccccgttacccgttacccgtaacggtaaccgttacctaccgtaccgtcggaacggtccgggtaccggtcgggacggtaaccgggccgtaccggtaacgtacggagctacgcancgtcgangcg

SEQ ID NO: 42629 - DNA, 630 bp, Homo sapiens
  misc_feature: GYAE6OF02I91QQ.9.9.A09.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (612)..(612): a, c, t, g, unknown or other
  misc_feature (612)..(612): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (629)..(629): a, c, t, g, unknown or other
  misc_feature (629)..(629): n is a, c, g, or t
tcagtgatacgtctcacgaccggtgctcgatttagcgagacgcgcagggtcctgggcccagtctgtgctgacgcagccgccctccgcgtccgggtctcctggacagtcggtcaccatctcctgccactggaaccagcagtgacattggtgcttataactatgtctcctggtaccaaacagcacccaggcaaacgtccccaaatcatgatttangagtcaatagcgccctntgggtccctgatcgcttctcctggctcccaagtctggaccaacacggcccttccctgaccgtctacgtcgggctccaggacttacggaccgtagtcggaggtaccgtagtatttacttacgtcggcacggtcttaccaattaacgcgacgtagaccaaccctaaacgaatttgggtcctttaccgggaaggtcggggtaaccccgaaccgggttccctaaccgggttaccgtacggtacgaaccgtaccccgaaaggtaccccggaaacccacttgtactaccgtccttaccggtcccctaccctcgttacgaacgaccgttactacgacttcggacggcgggtccgtacgggaccaacggggcctaacgtacgtaggactntctcgncncgancnntnc

SEQ ID NO: 42630 - DNA, 619 bp, Homo sapiens
  misc_feature: GYAE6OF02IZWNJ.9.9.A09.1.454.CMB.1.raw
  modified_base (611)..(611): a, c, t, g, unknown or other
  misc_feature (611)..(611): n is a, c, g, or t
  modified_base (617)..(619): a, c, t, g, unknown or other
  misc_feature (617)..(619): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagctccaggaacacgtccccaaaccctcatctataggtaatagtaatcggccctcgacggggtcccagaccgattctctggctcaagtctggcacctcacgccctcctcggcctatccacgtgggcttcgaggtctgaggatggagctgattatactcgcctaactcctaatcgacagcacgctagaacgtaagtgttaggtagttcgggacgggaacgggaccaacggtcgtacggtacccgttccgtaacggtacgacggtacccgaacggtcctcccggtcccccgttacggtcctaaccgttccgttcccggtttcccccgacccgttacccgtaccgtaaccggtaaccggttactacccgtaacgtacggaaccgggtccgggtacggtaccggacggtaacgggcccgtacgtaacggtagactgacncagcannn

SEQ ID NO: 42631 - DNA, 609 bp, Homo sapiens
  misc_feature: GYAE6OF02IUN4T.9.9.A09.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (207)..(207): a, c, t, g, unknown or other
  misc_feature (207)..(207): n is a, c, g, or t
  modified_base (278)..(278): a, c, t, g, unknown or other
  misc_feature (278)..(278): n is a, c, g, or t
  modified_base (510)..(510): a, c, t, g, unknown or other
  misc_feature (510)..(510): n is a, c, g, or t
  modified_base (593)..(593): a, c, t, g, unknown or other
  misc_feature (593)..(593): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (607)..(608): a, c, t, g, unknown or other
  misc_feature (607)..(608): n is a, c, g, or t
tcagtgatacgtctcacgaccggtgctcgatttagcgagacgcgcagggtcctgggcccagtctgtgctgacgcagccgccctcagtgtctggggccccagggcagaggtcaccatctcctgcactgggagcagctccaacatcgggaatcgntatgttnacactggtaccagcagtcttccaaggaacacgtacccccaaaccctnatctataggtaatagaactccggcccgtgtacggggtccctgaccgtattctcgtcgacctccaagttcgnggaccacctcgaccgtccccgtaccgtcggaccctatccgaacggtcgggttcttcggacggtcgtgggaggagtgaacgggtctagttaatttacgttaccgtcgtcctaacccttactaacgtacgacgtacgcaacgtctaggtagtacgtgtacgtcggtcggacgggacgaacgagcgtacggtccgtagtacgcacggacccgtacggtcctaccggtcccacgtntacccttcgttccctccctccctacttcgaacgtctactccacggtcgacggtccgtaggtccgacggacggccacgtagtcncgatcgngnannanng

SEQ ID NO: 42632 - DNA, 745 bp, Homo sapiens
  misc_feature: GYAE6OF02JJDWT.9.9.A09.1.454.CMB.1.raw
  modified_base (229)..(229): a, c, t, g, unknown or other
  misc_feature (229)..(229): n is a, c, g, or t
  modified_base (731)..(731): a, c, t, g, unknown or other
  misc_feature (731)..(731): n is a, c, g, or t
  modified_base (739)..(739): a, c, t, g, unknown or other
  misc_feature (739)..(739): n is a, c, g, or t
  modified_base (744)..(744): a, c, t, g, unknown or other
  misc_feature (744)..(744): n is a, c, g, or t
tcagtgatacgtctcacgaccggtgctcgatttagcgagacgcgcagggtcctgggcccagtctgtgctgacgcagccgccctcagtgtctggggccccagggcaggagggtcaccatctcctgcactgggagcagctccaacatcgggaatcgctatgttgtacactggtaccagcagtccttccgaggaacacgtacccccaaaccctcatctatggtaatagtaancgccctacgacgggtccctaggaccgtattcctacgtcggacctaccgtaagttccgtacgggaccctaacccgtcgtaaccgtaccccgttcccgttcgggaccctacttaccgtaaccggttacggggtcctttaccggaacggtaccgtagggaaaccggtagttacgggaacggtacttaggttaactttaacgttacgtcggaccctacttacccgttaagtcgactaggtacccgtagtcccgtaaaggtaacggtaggttacggtagggtttaccgtacgggggtacgggaaccgggaaccgtaaggacgttaccgggaaccccgttacggtaacggtacgtaaccggaccgtaaacggtccgttaccgtcccccgtaacgttaaccgttccgttccgttaccccgcccttaccgtacgaccggtacgttactccgtacgtacggcgggtaccgtaggtaccgacggaggtaccgacgtaacgtacgctgagacncgacgtancgcgnc

SEQ ID NO: 42633 - DNA, 657 bp, Homo sapiens
  misc_feature: GYAE6OF02IIZ4T.9.9.A09.1.454.CMB.1.raw
  modified_base (132)..(132): a, c, t, g, unknown or other
  misc_feature (132)..(132): n is a, c, g, or t
  modified_base (207)..(207): a, c, t, g, unknown or other
  misc_feature (207)..(207): n is a, c, g, or t
  modified_base (296)..(296): a, c, t, g, unknown or other
  misc_feature (296)..(296): n is a, c, g, or t
  modified_base (638)..(638): a, c, t, g, unknown or other
  misc_feature (638)..(638): n is a, c, g, or t
  modified_base (654)..(654): a, c, t, g, unknown or other
  misc_feature (654)..(654): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggancagcctccaacatcgggaatcgctatgttgtacatggtaccagcagcttccaggaacacgtacccccaaaccctnatctagtggtaatagtaactccggccctcgacgggtcccctagacccgtattcctcgtcggcctacgaaagttctcgggacctaccctnacgtcccttacccgtggaccctatccacggttcgggtcctttcgaagggtccttaggaacggtatcgggagtccgtagtaactttataccgtgacccctagttacctagtacgactagacagccttaggaagtacggttgtacggttagtccgggaggagaccgtagcgtacgtacccgtacgttagacgaacgcccgtaagggcccttccggtcccccgtacggtaccttaccgttttcccgtaccccgtcccttcctaaccgacgtaccgtaacgtcctaaccgtggtaacggtcgggtaccgtaggggactaacgggactaccgaacggttgactgacncgaggtccagtcgtcngac

SEQ ID NO: 42634 - DNA, 652 bp, Homo sapiens
  misc_feature: GYAE6OF02IVV57.9.9.A09.1.454.CMB.1.raw
  modified_base (639)..(639): a, c, t, g, unknown or other
  misc_feature (639)..(639): n is a, c, g, or t
  modified_base (647)..(652): a, c, t, g, unknown or other
  misc_feature (647)..(652): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacatcgggaatcgctatgttgtacactggtaccagcagcttccgagaacacgtaccccaaaccctcatctatggtaatagtaactccggcctcgacggggtccctgtaccgtattcgtctcggacctaccgtaagtcctggacctacctcgaccgtccctcccgtggccactcgacgttgggtccttcgaggctaggacggtatacggacggtcttagtaatttacgtacgtcgaccctaacgttcctaatcgaacgcgacgtacggccgtaggaaggttaaggtggttacggttacgtttcggggacggggacggtaaccgacggtcgtacggtacccgttacgtacggtacgacggacccggtaacggccgtaccgtcccccgttacggtaccgtacccttccgttaccgttccctaccccgttaccctacgtacgtaacgttctaccgtacgtacgacgggccggtcgtacggaacgacggacgtacgtaacgtngtcagcgnnnnnn

SEQ ID NO: 42635 - DNA, 675 bp, Homo sapiens
  misc_feature: GYAE6OF02HJK2R.9.9.A09.1.454.CMB.1.raw
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (670)..(675): a, c, t, g, unknown or other
  misc_feature (670)..(675): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagcctccaacagtcgggaatcgctatgttgtacactggtaccagcagcttccaggaacacgtaccccaaaccctcatctataggtaatagtaactccggccctcgacggggtccctggaccgtattcctcgtggcctccgaagttcctcggcctacctcaccgtcccctcccgtcggccctactccgtacggtcgggtccttccgaggtcgtggaggtagtggtacggtcttagtatttacgtacgtccgacctacctactagtcgaacgacgcgacgtccgtaggtaacgtaaggttcggttacgggttacggtttccgggggaaccgggaaccgggtaaccgtaacggtaccgtaccgggtacccggttacccggtacggtaccgaaccggtaccccggaaccgggtcccgttccccggtcccccgttaccggtccctaccgttcccgtccccgttcccgccctcccgtacgacgtacttcgtccgtaacgtcgaccggcggtcgacgacggaccggtcacgtagcgngngcngnnnnnn

SEQ ID NO: 42636 - DNA, 540 bp, Homo sapiens
  misc_feature: GYAE6OF02HDJFY.9.9.A09.1.454.CMB.1.raw
  modified_base (470)..(470): a, c, t, g, unknown or other
  misc_feature (470)..(470): n is a, c, g, or t
  modified_base (531)..(531): a, c, t, g, unknown or other
  misc_feature (531)..(531): n is a, c, g, or t
  modified_base (535)..(536): a, c, t, g, unknown or other
  misc_feature (535)..(536): n is a, c, g, or t
  modified_base (538)..(540): a, c, t, g, unknown or other
  misc_feature (538)..(540): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtccccaaaccctcatctataggtaaatagtaatccggccctcgacggggtccctgaccgattctctggctccaagtctggcacctcacgccctccgtggccatccacgtcgggtcttcgaggtctaggaggatggaacggctagtaagttttactaccgtgccctactccctagtcgacagcagctagaagaagttgtaggtatcgggcggagggaccaagcgtcgaccgtcgtagcacgccgaggtctcgtcccgcggtcactcgtcgtcccgtccncctcgacgtacgtactccacgtcgacggtcggctacggcgaacggtcgactagtagcagtnacgnncnnn

SEQ ID NO: 42637 - DNA, 783 bp, Homo sapiens
  misc_feature: GYAE6OF02GX6RQ.9.9.A09.1.454.CMB.1.raw
  modified_base (207)..(207): a, c, t, g, unknown or other
  misc_feature (207)..(207): n is a, c, g, or t
  modified_base (777)..(777): a, c, t, g, unknown or other
  misc_feature (777)..(777): n is a, c, g, or t
  modified_base (782)..(782): a, c, t, g, unknown or other
  misc_feature (782)..(782): n is a, c, g, or t
tcagtgatacgtctcacgaccggtgctcgatttagcgagacgcgcagggtcctgggcccagtctgtgctgacgcagccgccctcagtgtctgggccccagggcagaggtcaccatctcctgcacgtgggagcagcctaccaacagtcgggaatcgctatgttgtacactggtaccagcagcttcaggaacacgtacccccaaacctnatctatagtaatagtaactccggccctcgcgggtcctgaccgtattctcgtcgctaccaagtctcggccacctcgaccgtccctacccgtggccctaatccgacgtccgggtccttacggagggtccgtagggagggtacgtggtacggtcgttagtaacgttttaacgttaccgtacggaccccttaaccgttacccgttaagtaccgtaaccgaaggacctaccggcgttaagggaacggttaaaggttcgggttaacggtttaacgggtttccgggggaacggggtaacgggtaaaccgtaacggtacccggtaccgggtacccggttaccggttaaccgggtccgaaccggtaaccccggaaccggtacccggttaccccgtaccccccggttacccggtacccgttacccgtttccccggttaccccggtttcccccgttaccccgttccccgtaacccggtaaccgtacccgttaaccgtacccgttaccggtacggtaacccgggtccgggaccggtacgggaccggacgggtaccggtacgaacggtcgacgtgctcgagcncgcgnc

SEQ ID NO: 42638 - DNA, 768 bp, Homo sapiens
  misc_feature: GYAE6OF02I89GY.9.9.A09.1.454.CMB.1.raw
  modified_base (104)..(104): a, c, t, g, unknown or other
  misc_feature (104)..(104): n is a, c, g, or t
  modified_base (737)..(737): a, c, t, g, unknown or other
  misc_feature (737)..(737): n is a, c, g, or t
  modified_base (765)..(765): a, c, t, g, unknown or other
  misc_feature (765)..(765): n is a, c, g, or t
tcagtgatacgtctcacgaccggtgctcgatttagcgagacgcgcagggtcctgggcccagtctgtgctgacgcagccgccctcagtgtctgggccccagggcngaggtcaccatctcctgcactggcagcagttccaacatcggggcaggttactgatcgtccactcggtaccacgtctagtttcccagggtaaccgacgtccccccgtaacgggtcccttccgtacttccgtttgggtaacctaggttaaacgtccggtacccctcggtacggggtcccctcgtaacccgtattccgtcgtccggacctacccgtaaacgttccgtacgaaccgtaccccgttaccacggtcccccttccccgtcggtaccctacgttccgtaccgtacggggtcctccgacgtacctgggtacggactcggtaacggtccttacgttacttacgttaccgtacgtaccctacggttcgttaacgtacggtaaaccgtaaccgttaccgagtaaaccgttacggtttagggtccgttccgggacggtaaccggtaactacgtacgtaccgtacccgtcctacgtaccgtacgtaccgacctacggttcctacccggtccccgttccggtactcccgttaccgttcccgtcccgtacccctccgtacaccgggttacctccgtaccgaccggtaagccggtcccgggtacgccgtaacgggccgcttacggtacgaacggtcgtanacggtcgactcgacgtatccgattccgntcc

SEQ ID NO: 42639 - DNA, 694 bp, Homo sapiens
  misc_feature: GYAE6OF02G1FVZ.9.9.A09.1.454.CMB.1.raw
  modified_base (205)..(205): a, c, t, g, unknown or other
  misc_feature (205)..(205): n is a, c, g, or t
  modified_base (340)..(340): a, c, t, g, unknown or other
  misc_feature (340)..(340): n is a, c, g, or t
  modified_base (689)..(689): a, c, t, g, unknown or other
  misc_feature (689)..(689): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgacacgtggtaccagcagcttcaggaacacgtaccccaaaccctnatctataggtaatagtaactccggccctacgaggggtccctagaccgtattctctgcctacaagtctggccacctcacgccctcccgtagccatcacgtggcttcgaggctgagatggaggtctgtattattacncgaccacttacctaatcgaaacgtcgtaacgacggtccgtaaggaacgtaaagtggttacggggttaacgttccggggacggggaacgggtaaacccgaaggtccgtaacggtaacccggttaccggttaacgggacctaacgggaccccgtaaagggtcccttaacccggccccccgttacggtaccgtacctaccgttttacccgttaccccctacccgttacccgtaccgtaacggtacccgttaacgtaccgtaaaccggttaggaaccgggggcccgggttaacgacggggtaaccaacgggtaccggaaccgaacggtaagccgtaagactagtactagacgnatacg

SEQ ID NO: 42640 - DNA, 753 bp, Homo sapiens
  misc_feature: GYAE6OF02HQC55.9.9.A09.1.454.CMB.1.raw
  modified_base (736)..(736): a, c, t, g, unknown or other
  misc_feature (736)..(736): n is a, c, g, or t
  modified_base (742)..(742): a, c, t, g, unknown or other
  misc_feature (742)..(742): n is a, c, g, or t
  modified_base (751)..(751): a, c, t, g, unknown or other
  misc_feature (751)..(751): n is a, c, g, or t
tcagtgatacgtctcacgaccggtgctcgatttagcgagacgcgcagggtccctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaaccctcattctatgtaatagtaactccggccctcgacggggtccctgaccgtattcctcgtcggcctaccgaagtcgtcggcctacctccgacgtccccttcccgtcggccctactccgacgttcgggtcctttacggcggtccgttaggaacggtagtgggaacggtcttagtaattttacgttaccgtcgacccgtaccttacgtagtacgaaccgtacgacgacgtccgtaggaaagttaggttaggttacggttacggttaccggggaacgggtaacgggaaccgtaacggtaccgttacggtacccggttaccggttacgggtaccgaccggaacccgggtaccgggtcccgttaccccgggtccccccggttaccggttacccgttacccgttcccgtttcccccgttacccccgttaccccgttccccgttaccgtaaccgttaacccgttaccgttaccgtaaccggtcggaaccgggtcgggaccggtaccgggtacggaaccgggccgtaacggtacgacggcgnacgctnggctagacncg

SEQ ID NO: 42641 - DNA, 547 bp, Homo sapiens
  misc_feature: GYAE6OF02HHDOW.9.9.A09.1.454.CMB.1.raw
  modified_base (203)..(203): a, c, t, g, unknown or other
  misc_feature (203)..(203): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(547): a, c, t, g, unknown or other
  misc_feature (545)..(547): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggacagtccccaaaccctnatctatggtaatagtaatcggccctcgacggggtccctgaccgattctctggctccaagtctggcacctcagcctcctggccatcactggcttcaggctgacggatggaggctgatttatactgaccactcctatgacagcagcctagacgtaagtggtaggttattcgggcggagggaccaaggcttaggaccgtcgtaggtcacggaccgtaaggcctaccggtccccctcggtacctaccgttccgtccgttccccgcccttcccgtcgtaacgtaccgtactcgacgtacgcggtcggtcgtcggaccgtaacgggcacacgtcgactgcgcncnncnnn

SEQ ID NO: 42642 - DNA, 807 bp, Homo sapiens
  misc_feature: GYAE6OF02HAPO7.9.9.A09.1.454.CMB.1.raw
  modified_base (208)..(208): a, c, t, g, unknown or other
  misc_feature (208)..(208): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (803)..(803): a, c, t, g, unknown or other
  misc_feature (803)..(803): n is a, c, g, or t
  modified_base (805)..(806): a, c, t, g, unknown or other
  misc_feature (805)..(806): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactggggagcagctccaacagtcgggaatcgctatgttgtacactggtaccagcagcttccaggaacacgtaccccaaaccctnactctatggtaatagtaactccgccctcgacggggtccctgaccgtattcctcgtcggccttaccgaagttccgtcggccctaccctcgacggtccccttccccgtggcccattccgaccggttgggcctttaccgacgggtccgttgggaacgggtcgttagggtacggtacttacggtaacttttaacgttaccgtcggtaaccctacccgttccgtaaacgttacggaacctacggtacccgacggtcccgttaaggaacggttaaagggttgggttacgggttttaaccgggttaccggggggtacccgggggtaaacggggtaacccgtaaaacgggtccggttaaccggtaaccccgggttacgggttaaaccgggttaccgaaacccggtaccccggaaacggtccccgttaccccggtaccccccggtttaccgggttacccttacccgtttcccgtttcccgttaccccccgtacccgttaccccgttaccgtaccggttaacctaacgttccgaaccggtcggtaccgggaccggtcggtaccggtaccgaacgggtccgacgtaacggtcgagtgcgacngncncnnc

SEQ ID NO: 42643 - DNA, 658 bp, Homo sapiens
  misc_feature: GYAE6OF02HX1U3.9.9.A09.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
  modified_base (423)..(423): a, c, t, g, unknown or other
  misc_feature (423)..(423): n is a, c, g, or t
  modified_base (612)..(612): a, c, t, g, unknown or other
  misc_feature (612)..(612): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(658): a, c, t, g, unknown or other
  misc_feature (657)..(658): n is a, c, g, or t
tcagtgatacgtctcacgaccggtgctcgatttagcgagacgcgcagggtcctgggcccagtctgtgctgacgcagccgccctcagtgtcgtggggccccagggcagagggtcaccatctcctgcacgtgggagcagcctaccaacatccgggaatcgactatgttgtaccacgtggaccagcagtcttccgaggaaccacgtacccccaaaccctnatctataggtaaatagtacgtcggcctaggacgggtccctgaccgtnttcgtcgtggcctaccgaagtcgtgacctacctcgacgtcccctccgaggtacctaacgtcctcggtggtacctttcgaggaccttaggaacggtaagttaggcgtacgtagtttaaccttaactttccgcgtaccctaaccgtcttaagacggacacncggtactcgtaagggtaataggtgttagggacttgggggaccggacgtacgacgtccgtacggtaccgtacgtaaggtcaaccggaccgtacggtaccgtaccccgtcccgtacgccgtactccggtccctaccctacccggtaccttacgaaccgttcgtactaccgtacgtacggccgggtaccggnggtaacggtcggaacgtccgtaactcggtaacngcntcngncngnn

SEQ ID NO: 42644 - DNA, 704 bp, Homo sapiens
  misc_feature: GYAE6OF02JM0Z0.9.9.A09.1.454.CMB.1.raw
  modified_base (131)..(131): a, c, t, g, unknown or other
  misc_feature (131)..(131): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (703)..(703): a, c, t, g, unknown or other
  misc_feature (703)..(703): n is a, c, g, or t
tcagtgatacgtctcacgaccggtgctcgatttagcgagacgcgcagggtcctgggcccagtctgtgctgacgcagccgccctcagtgtctggggccccagggcagaggtcaccatctcctgcactgggancagctaccaacagtcgggaatcgacttatgttagtaccactggtaccagtcagccttacgacggacacgtaccccaaaccctcatcgtatggtaatagtaactccggcctcgtacggggtccctgaccgtattctagtcgctaccgaagtccgtaggtacctcgaacgtcccctcccgcggtctactctacgttcgggtacttacgaacgggtcctagggacgggtaatccgggtaggtacttacggtaacttttacggttaaccgttccgaacccgtcgtttacccttagtaaccgggtaacacccggtcgtaacgcccggttaagggaagtttaagggttcgttaggggtttaccgggtacgggacgggtaacggggtaaccacggttacgtaccggtacccgttccggtaccggtacctaccggaaccggaacggtccgtcccggtcccgttacccggttacctccgtacttcccgtaccccgttaccgtaccctcgtacgtacgtcctacgtcgtcggtacggcgtacggcgcgacggccgtaacagagctacgncgtacnctgctgnc

SEQ ID NO: 42645 - DNA, 770 bp, Homo sapiens
  misc_feature: GYAE6OF02GMZL3.9.9.A09.1.454.CMB.1.raw
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (756)..(756): a, c, t, g, unknown or other
  misc_feature (756)..(756): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
  modified_base (766)..(766): a, c, t, g, unknown or other
  misc_feature (766)..(766): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacagtcgggaatcgctatgttgtacactggtaccagcagcttccgaggaacacgtaccccaaaccctnatctataggtaatagtaactccggccctcgacggggttccctaggaccgtacttcgtctcggcttccgaagttcncggccaccttcgactcccgtaccctggccctatccacggttcgggtccttacgacggtcgttgggaacggtatacgggaggttcctaggttaacttttacgttacgcgtaccctaccgttacctagtcgaacgtacgaccgtacgtccgttaggaacgtaaaggtttcggtttacggggttacgtttccgggggaccgggtaacgggtaacccgtaacggtcccgtacggtaaccccgttaccggttaccggtacggtaaacccgtacccggtaacgggtcccgttcccccggtacccccgttaccgggttacccttaaccggtttcccggtttaccccggtttaccccccgtccccgttaacccggtacccgttaacggttaacccggttacgtacccgttaccggtacggtaaccggggccggtacggtacgggtaccggaaccgggtccgtacgtaagttacgcgtacnggcngngctnatcg

SEQ ID NO: 42646 - DNA, 648 bp, Homo sapiens
  misc_feature: GYAE6OF02GMRJU.9.9.A09.1.454.CMB.1.raw
  modified_base (142)..(142): a, c, t, g, unknown or other
  misc_feature (142)..(142): n is a, c, g, or t
  modified_base (165)..(165): a, c, t, g, unknown or other
  misc_feature (165)..(165): n is a, c, g, or t
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (641)..(641): a, c, t, g, unknown or other
  misc_feature (641)..(641): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaanatcgggaatcgctatgttgtacnctggtaccngcagcttcaggacngtccccaaaccctcatctatggtaattagtaactcggcccttcgacggggtccctgaccgnttctctcggctaccaaggttcncggcctacctcacgcccctccctggaccctntccacggtcgggtctttacgagggccttaggaaggtatgggacgtcttaggtaatttacgtctacgcctaaccttcctagttacgcaagtccgacgttacaggaaggtacgttggttacgtacggttcggggacggtacggaaccgagtcgtaccggaccgttcgtacggtaccgacggtacccgacggtccgttcccgccccgttccggtacctacccgttcctcccggttcccctcccgtcccgttacgacgttacgttaccgtctacctcggaccgggtcggtccggttacggaccggaaccggggtctaaccggtacgtaacgtcagtacgcgancggncnn

SEQ ID NO: 42647 - DNA, 504 bp, Homo sapiens
  misc_feature: GYAE6OF02FLWN4.9.9.A09.1.454.CMB.1.raw
  modified_base (494)..(494): a, c, t, g, unknown or other
  misc_feature (494)..(494): n is a, c, g, or t
  modified_base (498)..(504): a, c, t, g, unknown or other
  misc_feature (498)..(504): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcacggggtccctgaccgattctctggctccaagtctggcacctcagcctccctggccatcactgggcttcaggctagaggatgaggctgattattactgccactctatgacagcagcctagagagtgtggtattcggcgggacggacagctacgaccgtctaggcacgcccgaaggcctcgcccccgtggtccactcctcgttcccaccctcctcacgtactactacacgtgcgcgggtctcgggacgacggcgctagtagcgtncgtnnnnnnn

SEQ ID NO: 42648 - DNA, 553 bp, Homo sapiens
  misc_feature: GYAE6OF02J1O8I.9.9.A09.1.454.CMB.1.raw
  modified_base (135)..(135): a, c, t, g, unknown or other
  misc_feature (135)..(135): n is a, c, g, or t
  modified_base (168)..(168): a, c, t, g, unknown or other
  misc_feature (168)..(168): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (510)..(510): a, c, t, g, unknown or other
  misc_feature (510)..(510): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
tcagtgatacgtctcacgaccggtgctcgatttagcgagacgcgcagggtcctgggcccagtctgtgctgacgcagccgccctcagtgtcgtcggggccccagggcaggagggtcacctattcctcctgctacgngggacgcgacgcctacaacgaagtgggaactcngtagtcgttgtactacgttggtaccagactcgtccttaccgaaggaaccctacgaccccaccgtatacgttctagtagttaagacgtaccgtcggccgtcgaccggttccagtacctgttcctcgctccgacgtatcgngcncgtcncgcctcgaccngtcaatcgtcgatcncggnagtagngctagtctatctntccncnccgtatcgnacgctcngacgtgagctggtntagacgtcgagcgtacgngtacgcgtcgngcgtcgcgcgtcgtccgccgtctcgtccgtctccgtaccgtcctcgtaccgngtacncgaccgtcgcggttcgcgacggtnccggtagcgacgtacgcgacgtcgagcncncgngcgtacntcg

SEQ ID NO: 42649 - DNA, 714 bp, Homo sapiens
  misc_feature: GYAE6OF02I6828.9.9.A09.1.454.CMB.1.raw
  modified_base (267)..(267): a, c, t, g, unknown or other
  misc_feature (267)..(267): n is a, c, g, or t
  modified_base (660)..(660): a, c, t, g, unknown or other
  misc_feature (660)..(660): n is a, c, g, or t
tcagtgatacgtctcacgaccggtgctcgatttagcgagacgcgcagggtcctgggcccagtctgtgctgacgcagccgccctcagtgtctggggccccagggcagaggtcaccatctcctgcacgtgggagcagctaccaacatcgggaatcgctatgttgtacactggtaccagcagccttacaggaactacgtaccccaaacctcatctatagaatagtaacgtccgacctcgaacggggtcctagaccgtacttacgtacgcngggaacttccaaaggtcctacgggtacctaaccgtcgacgtaccgtaccctaggaccctaagttccgaacgttcgggaccttacgaacggtacgtaggacgtaacgtcggtacggtacttaggtaactttacgtaccgtacgtacccgtaactaccgtaacgtacggactaacggtacctaacggtacgtaggtaacggtacgttaggtacggtacgtacgggacggtaacggaaccgtaacgtacgtacgtacgtaccgtaacggtaccgtaacgaccgtaacggtaccgtaccgtacccgtacgtacctaccgtaccgtaccgtacccgtacccgtaccgtacgtaacgtaaccgtacgtaccgacgtacggacggtaccggtacgtacgntaacggtaaccgtaccgtaacgtacggtacgtacgtacgacgtacgtacgtacg

SEQ ID NO: 42650 - DNA, 750 bp, Homo sapiens
  misc_feature: GYAE6OF02HXGFA.9.9.A09.1.454.CMB.1.raw
  modified_base (212)..(212): a, c, t, g, unknown or other
  misc_feature (212)..(212): n is a, c, g, or t
  modified_base (734)..(734): a, c, t, g, unknown or other
  misc_feature (734)..(734): n is a, c, g, or t
  modified_base (739)..(739): a, c, t, g, unknown or other
  misc_feature (739)..(739): n is a, c, g, or t
  modified_base (745)..(745): a, c, t, g, unknown or other
  misc_feature (745)..(745): n is a, c, g, or t
  modified_base (748)..(748): a, c, t, g, unknown or other
  misc_feature (748)..(748): n is a, c, g, or t
tcagtgatacgtctcacgaccggtgctcgatttagcgagacgcgcagggtcctgggcccagtctgtgctgacgcagccgccctcagtgtctggggccccagggcaggagggtcaccatctcctgcacgtgggagcagctccaacatcgggaatcgctatgttgtacacgtggtaccagcagtcttaccgaggaacacgtaccccaaaccctnactctatacgtaatacgtaactcggcctggaccggggtccctaggaccgtattcctcgtcggccttacgaagttcgtacggcctaccgtcacgtcccctcccgtacggacccacttcgaaccggttcgggtcctttacggacgggtccgttaggaacgggtacgtacggacgggtactttacggttaaactttacgttccgttaccgacccgttaaccttctaacggtacgtaacgacgtaccgtacggttaccgtagggaaaacgttcggttagggttacggttacggttccgggggaacgggtaaccgggtaaccgaaggtcccgttaacgggtaccccgtttacggtacgggtaccgaaccgggtaccccgaaaggtcccgttaccccgtaccccggttcggtacccttccgttcccgttccgttaccccgttcccctaccgtacgtaccggttaacctcgttaaccgcgttaggaccgggtcgacgtccgggtacgacgggtccaggtaacgtgacgngtacncgagcngcntc

SEQ ID NO: 42651 - DNA, 691 bp, Homo sapiens
  misc_feature: GYAE6OF02IQ6Y6.9.9.A09.1.454.CMB.1.raw
  modified_base (139)..(139): a, c, t, g, unknown or other
  misc_feature (139)..(139): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (680)..(680): a, c, t, g, unknown or other
  misc_feature (680)..(680): n is a, c, g, or t
  modified_base (682)..(682): a, c, t, g, unknown or other
  misc_feature (682)..(682): n is a, c, g, or t
  modified_base (686)..(687): a, c, t, g, unknown or other
  misc_feature (686)..(687): n is a, c, g, or t
  modified_base (689)..(691): a, c, t, g, unknown or other
  misc_feature (689)..(691): n is a, c, g, or t
tcagtgatacgtctcacgaccggtgctcgatttagcgagacgcgcagggtcctgggcccagtctgtgctgacgcagcccgccctcagtgtctcggggccccagggcaggaggtcaccatcctcctgacagtgggagtanctaccaacagtccgggaatcgacttagtggtttactacacgttcgtaaccacgctacgtccttacccgaaaggaaccctacccgttaaccccccaaaccccttcacttacttagttaggtaaacgtaagtaacgttcccggccctacggtaccggggtccctacgaccgtacttcctcggtcgtcctaacctaacggttcacggacctccgtcacggtccctccggtcgactaacgtcgagtccggtaccgtagacgtctaggaggactggagcttagtaacttgttaccncgactaacgtctacgtagacnggtacncctcgaaggtagtacgggttgttgggtcggtacgggcggtaaacgtaacgacgttacgtacgtccggtacgtagtaccgacccggtaccgaccggtcccgttcccgcccggttaccctacggttacccttccggttacccgcccccgtaccgtaccgtcctaaccgggtaccttacgacggttcgcggtacgcgtacgacgacgacgtcgaactntcntactnancgcnncnnn

SEQ ID NO: 42652 - DNA, 837 bp, Homo sapiens
  misc_feature: GYAE6OF02JRO11.9.9.A09.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
  modified_base (832)..(832): a, c, t, g, unknown or other
  misc_feature (832)..(832): n is a, c, g, or t
  modified_base (834)..(834): a, c, t, g, unknown or other
  misc_feature (834)..(834): n is a, c, g, or t
tcagtgatacgtctcacgaccggtgctcgatttagcgagacgcgcagggtcctgggcccagtctgtgctgacgcagccgccctcagtgtctcgggccccagggcagagggtcaccatctcctgcactgggagcagctccaacagtccgggaatcgactagtcggttgacncgtggtaccagcgtgcttccgagacncgtacccaacccnactctagtacggtaatacgtaagtccggcctaggtcgggtccctagacccgttatttccncgttcggacctaccgtaacgttccgtacggtcccaccttaccgccgttcccgtacccgccgggtacctaacctggtaccggttcgggtacctttacggaagtccggtttacggggaaaccgtggtccggttaacgggtcttaagggtaaccgttttaccttacggaaacggttccccttaaccgtttaccgtaaacgggacttaaccggaagggtttaccccaacgggttcccggttaaagtaaaccggggtttggttcccgggttttaaagggcccgggttttacccgggggaccggggtaaaccggacccggtaacggtaccgggttaacccgggtaccggttacccgttacggaccggtaccggttacccggaacccgttccggttaaccccggttcccggttaccggttaacccgttacgttccgttaacccgttaccccgtccgttaccgtaccgtacggttaacaccggtttacgaccggtaacggttacgggccggtaaccgtcggtaccgggaaacgtccgttacccgaagttccggatccgacgcgcgcgtcgngngcg

SEQ ID NO: 42653 - DNA, 627 bp, Homo sapiens
  misc_feature: GYAE6OF02HAGCB.9.9.A09.1.454.CMB.1.raw
  modified_base (207)..(207): a, c, t, g, unknown or other
  misc_feature (207)..(207): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
  modified_base (624)..(627): a, c, t, g, unknown or other
  misc_feature (624)..(627): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctaccaacagtcgggaatcgctatgttgtacactggtaccagcagcttccaggaacacgtccccaaaccctnatctatggtaaatgtaatccggcctacgacggggtccctgaccgtattcgtcgtggcctaccgaagtcgtacggcctacctacgacgtcccctccgtcggaccacgttacacgttcgggtccttacggacggtcgtaggacggtagttcggaggtccgttagtaagtttaacttacgtcgaccctactccgtatcggaacagacgacgcctagggaacgttaggtggtacggtacgtcgggaaccggaggaaccagccgtcgaccgtcgtaggacacggacccgtacggccgtccgcccgtcgacctccgtccgtacccgttcccgtccctaccgtcgtacgtaccttacgtacctacgtacggacggtcgggcgtacgggaccgacgggtcgtaacagtacgngcgtntcgancgnnnn

SEQ ID NO: 42654 - DNA, 765 bp, Homo sapiens
  misc_feature: GYAE6OF02G60DQ.9.9.A09.1.454.CMB.1.raw
  modified_base (213)..(213): a, c, t, g, unknown or other
  misc_feature (213)..(213): n is a, c, g, or t
  modified_base (656)..(656): a, c, t, g, unknown or other
  misc_feature (656)..(656): n is a, c, g, or t
  modified_base (765)..(765): a, c, t, g, unknown or other
  misc_feature (765)..(765): n is a, c, g, or t
tcagtgatacgtctcacgaccggtgctcgatttagcgagacgcgcagggtcctgggcccagtctgtgctgacgcagccgccctcagtgtctggggccccagggcaggaggtcaccatctcctgcacgtgggagcagctccaacagtcgggaatcgctatgttagtacacgtggtaccagcagccttaccgaggaacacgtaccccaaaccctnatctataggtaaatagtaacgtccggccctacggtacggggtccctggacccgtattccgtcgtcggcctacccgtaaaggttccgtacggacctaacccgttccgaaccggtcccccttacccgtcggaccctaacgttccgtacggttcggggtcctttacggacggtccgtaggaaggtagttacgggacgtacgttaggtaacttttaacttacgtccgtacctaacgtttacctaagtacgaaccgtacggaccgacggtccgttaaagggaacgttaacggttgggtttacgggttaacggtccgggggaaccggggacgggtaaaccgtaagggtccgttaccggtacccggttacgtacggtacgaaccgacccggtaacgtcccgttacccggtccccgttacgtacctacccgttccgttcccggttcccccncccgttacctacgtaacccgttacgtaacctcgtaccgtacggaccggccgggtacgtacgggaccgacgggtaccacgtacggtagtcgtgactcgcagtcgactcgn

SEQ ID NO: 42655 - DNA, 717 bp, Homo sapiens
  misc_feature: GYAE6OF02HLCTX.9.9.A09.1.454.CMB.1.raw
  modified_base (219)..(219): a, c, t, g, unknown or other
  misc_feature (219)..(219): n is a, c, g, or t
  modified_base (425)..(425): a, c, t, g, unknown or other
  misc_feature (425)..(425): n is a, c, g, or t
  modified_base (710)..(710): a, c, t, g, unknown or other
  misc_feature (710)..(710): n is a, c, g, or t
tcagtgatacgtctcacgaccggtgctcgatttagcgagacgcgcgaggggtcctgggcccagtctggtgctgacgcagccgccctcagtgtctggggccccagggcaggaggtcaccatctcctgcactgggagcagctccaacagtacgggaatcgcttatgttgtacacgtaggtaaccagcagcttaccgaaggaacacgtacccccaaaccctnaactctaataggtaatagtaactccgcctcgacgggtcctagaccgtattctctaggtcctacgaagttcgtacggacctacccgtacaccgtacccttcccgtaggacccctaagtccgtaacggttccggggtacctttacggaacgggtccgtagggtaacggtacgtacggaagggttctaacggtaacgtttagttaccgnggtaacccttaggttaccgtaatacgaacgttaacgggtcggaaaccttaaaggtaaccttacgtccgttaaccgttacgggaacgtaccgggaaacctaacggtaccgtaaccggtccgtacggtacgaccgaccgaaccggacccaaccctacgtcgtacctactacgttccctaccctacctaccgtacaacgtaccttacgtacgaacgtcgaccgggtcggacgtacggaaccgtacgaccgttagtaacgtcgatactagacgctaggctaggatacgngactaag

SEQ ID NO: 42656 - DNA, 794 bp, Homo sapiens
  misc_feature: GYAE6OF02JS88U.9.9.A09.1.454.CMB.1.raw
tcagtgatacgtctcacgaccggtgctcgatttagcgagacgcgcagggtcctgggcccagtctgtgctgacgcagccgccctcagtgtctcggggccccagggcagagggtcaccatctcctgcacgtggagcagctcgaacatacgggaatcgctagtgttgtacacgtggtaccagctgaccttccgaaggaaccaccgtacccccaaaaccctcaacttctagtacggttaaagtagtaactccggtcccttacgggtacggggtccctacgtacccgtattcgtcgtcgcctaccgatcgtcggccactcctacgtccctccgtacgccagtacgacgttcggcctcggtaggccttaggacgtaggtacgaggtccttaggtacgtttcttaccgtcgaacccttacttcgtaaactcgaacgtacgtacacgtacgtaacgtaggttaaacgttcgggttacgtacggttaccgggaggggtaaccgtacgggtaaaccgtcgttacccggtaccgggttacgtaaccgggtaccgtaaaccggtacccgttaccggtccgtttaccccggacccccggttcccgtacgttaccccttaccggttccccgtttacccccgtacccggtttaccccttaacggtacccgttaaaccggggtttaccgtaaccgttaccgggtacggtacccgggacccgggtttacgaccgggtaacccggtacccgggtaacgtaaaccgttgttaaaccgcgtaccgtaggccggaaaccgttagtacgtgactcg

SEQ ID NO: 42657 - DNA, 711 bp, Homo sapiens
  misc_feature: GYAE6OF02GQV95.9.9.A09.1.454.CMB.1.raw
  modified_base (685)..(685): a, c, t, g, unknown or other
  misc_feature (685)..(685): n is a, c, g, or t
  modified_base (707)..(707): a, c, t, g, unknown or other
  misc_feature (707)..(707): n is a, c, g, or t
tcagtgatacgtctcacgaccggtgctcgatttagcgagacgcgcagggtcctgggcccagtctgtgctgacgcagaccgccctcagtgtctcgggccccagggcagagggtcaccatctcctgcactgggagcagctccaacatcgggaatcgctatgttgtacactcggtaccagcagccttcaaggaacagtccccaaaccctcactctatggtaatagtaatcggccctcaggggtccctgaccgattctctggcctccaagtctggcacctcacgcctccctggcccatcactgggcttcgaggctgaggatcggagctgattattacgtgcctactcctaatcgacctagccaacggccctaggaaggtaaagttggtagggttaacgttccggggacgggggtaacggggtaaccctaaagggtccgttacgggtaaccccggttacccgttaacgggttaccgaaacgggacccccgtaaaagggggtcccttaccgggtaccccccccgttacggggttaccctaacccgtttcccggttccggttttaccccccgaacccccgtttacccggttaccggaaggtacccggtttaacgtccgtaaaccggttacgggaaccggtccgggggtaccttacggggaccgtaacggggcccggaactacgttaaccggntacgcgtacgtaccgatgacgntacg

SEQ ID NO: 42658 - DNA, 781 bp, Homo sapiens
  misc_feature: GYAE6OF02JZBMS.9.9.A09.1.454.CMB.1.raw
  modified_base (213)..(213): a, c, t, g, unknown or other
  misc_feature (213)..(213): n is a, c, g, or t
  modified_base (765)..(765): a, c, t, g, unknown or other
  misc_feature (765)..(765): n is a, c, g, or t
tcagtgatacgtctcacgaccggtgctcgatttagcgagacgcgcagggtcctgggcccagtctgtgctgacgcagtcgcctcagtgtcgtggggccccagggcaggagggtcaccatctcctgcacgtgggagcagctccaacagtacgggaatcgcttatgttgtacactaggtaccagcagcttcgaggaaccacgtaccccaaaccctnaactctagtaggtaaactagtaacgtccggaccctcggaccggggttccctaggtaccgtactttcacggttcggaccttacgacgttcgtacggaccaccttaccgacggtaccccttcccgcggtacctaacgtccgttacggtcgggtaccttacgacgggttaccgtagggtaaggtacggttacggacgggttactaggtttaaacttttaaaccccggttcggtacccggttaacccgttacttaccggttttaaacggacgtaccgggtacgaccgtaacgaccggttaaagggtaaccggtaacggtttcgggttacgggttaaccgggttcggggaaacgggtaaccgggtaacaacggttccggttaccgtaccggttacgtacgtaccggaactacccggtaacgtccgtccccgtaccgtcgttactacgtccgtacccgtcctaccgtaccgtaacgtcgtaactccgtaacgcgtacggacggttcgaccgtacgtaccggtacggaccgtaacgttgaacgtcgacttacgaacgtnaggtacgctaccggta

SEQ ID NO: 42659 - DNA, 661 bp, Homo sapiens
  misc_feature: GYAE6OF02GW4LR.9.9.A09.1.454.CMB.1.raw
  modified_base (219)..(219): a, c, t, g, unknown or other
  misc_feature (219)..(219): n is a, c, g, or t
  modified_base (300)..(300): a, c, t, g, unknown or other
  misc_feature (300)..(300): n is a, c, g, or t
  modified_base (637)..(637): a, c, t, g, unknown or other
  misc_feature (637)..(637): n is a, c, g, or t
  modified_base (652)..(652): a, c, t, g, unknown or other
  misc_feature (652)..(652): n is a, c, g, or t
tcagtgatacgtctcacgaccggtgctcgatttagcgagacgcgcagggtcctgggcccaggtctgtgctgacgcagccgccctcagtgtctggggcccagggcagaggtccaccatcctcctgcactgggagcagcgtccaacgacgtacgggaatcgctatgttgtacacgtcggtaccagctagtcttccgaacgggaaaactccccaaacccgtnatactatggtaatagtagtcgcctgacgggtcctgaccgattcgcgtggcctcgaagtcgtgccacctcgacgcctcccgngcccatccgacgtcgggtccttggaacggttccgtaaggacggacggttggaccggttctaagggtaacttttacgttaccgaccgtaccttaaccttccgttaagccggtaaccgaggcccttaaggtcccgtaaggaacggttaaacggtttcggttaacgggttaccggtacggggacgggtacggaaccgacgtcccgtacggtaccgtcggtacgtacgaccgtaccgacggtctcccgtcccgtcgtcctaccgttcgtccgttacccctcctcgtactacggtacttcgctccgtagacggcgcgtacgacgtacgcggaaccttgacgntacgagtcagccgcngaccgttcg

SEQ ID NO: 42660 - DNA, 634 bp, Homo sapiens
  misc_feature: GYAE6OF02G99R3.9.9.A09.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (516)..(516): a, c, t, g, unknown or other
  misc_feature (516)..(516): n is a, c, g, or t
  modified_base (632)..(633): a, c, t, g, unknown or other
  misc_feature (632)..(633): n is a, c, g, or t
tcagtgatacgtctcacgaccggtgctcgatttagcgagacgcgcagggtcctgggcccagtctgtgctgacgcagccgccctcagtgtcgtcggggccccagggcaggagggtcaccatctcctgcacgtgggagcagcctccaacagtcgggaatcgctatgttgtacacgtggtaccagcagccttacgaggaacaccgtcccccaaaccctnatctataggtaatgtactccgcctgacgggtccctgaccgtnttccgtcgtagtcctacgtagtctcggacctaccgtcacgtccctcccgtcggaccctactccgtaacggtcgggtccttacgacgggtacgtacgggaggtatcgggtacggtcttaagtactttacgtaccgtccgacctacctcctagtcactacgcacgtctaggagtagtggtggtacggtcgggacggaggaccgacggtcgtacgtacccgtcgtacgtccacgtaccgcgtccgtccgtcccgtcgtccncgttcctcccttacccgtccctccgttaccgacgtaccgtactccgtacgtcggacggtcgggtaccgtcgtacgggaccggtaccgtaggtaacgagtcgactcgacgcgtcagnnc

SEQ ID NO: 42661 - DNA, 563 bp, Homo sapiens
  misc_feature: GYAE6OF02FLF96.9.9.A09.1.454.CMB.1.raw
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (501)..(501): a, c, t, g, unknown or other
  misc_feature (501)..(501): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(563): a, c, t, g, unknown or other
  misc_feature (560)..(563): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcgccctcgaggggtccctgaccgtattctcgtggctccaagtctggcacctcacgccctccctggacctatccacgtgggcttcgaggctggagtntgacgtctgtattnttacngccactctatgacagcncgctagagtagtggtaggttagtcgggacggaggaccgagtcgtcgtaccgtacgtaggtaccacgacccacggtcctccggcccccttcggtaccctcttccctccgttcccctaccctccgtaccacgtacgtacgtacctacgnggtacggtccgggtcgtcggacgacgggaccgacgtaagtaacgngtacngtcgngngnnnn

SEQ ID NO: 42662 - DNA, 732 bp, Homo sapiens
  misc_feature: GYAE6OF02H4IBH.9.9.A09.1.454.CMB.1.raw
  modified_base (725)..(725): a, c, t, g, unknown or other
  misc_feature (725)..(725): n is a, c, g, or t
  modified_base (729)..(729): a, c, t, g, unknown or other
  misc_feature (729)..(729): n is a, c, g, or t
tcagtgatacgtctcacgaccggtgctcgatttagcgagacgcgcagggtcctgggcccagtctgtgctgacgcagccgccctcagtgtctggggccccagggcagaggtcaccatctacctgcacgtgggagcagctccaacagtcgggaatcgctatgttgtacacgtggtaccagcagcttccaaggacacgtccccaaacctcatctataggtaatagtaactcggccctggacggggtccctggacccgtatttccgtcgtcggacctaccgtaaacggttccgtagggccctaaccgtccaacggtccccgttacccgttcggcccacttccgaaccggttcggggacctttcggaacggtcgttagggaacggtagttgggaacgtcgtagttacgtttaacttaccgtcgaccctaacttcccgtaagtcggacaacgggtcaacggtcccgttagggaaacgggttaagttcgggtttacggtacggtttacccgggggacggggtaacggggaaccgtaacggccgttacggtacccggttacggtacggtaccgacgtacccgaagtccgtaccgtccccgttacggtacctaccgtccgttaccgttccccgtccgttacccgcgtaaccgttcgtaccgttaccgtaccgtacggacggtccgggtacgttcggaccgtacgggccgtacggaatacgactcgatcgctagntacntcg

SEQ ID NO: 42663 - DNA, 887 bp, Homo sapiens
  misc_feature: GYAE6OF02J2WXL.9.9.A09.1.454.CMB.1.raw
  modified_base (131)..(131): a, c, t, g, unknown or other
  misc_feature (131)..(131): n is a, c, g, or t
  modified_base (146)..(146): a, c, t, g, unknown or other
  misc_feature (146)..(146): n is a, c, g, or t
  modified_base (225)..(225): a, c, t, g, unknown or other
  misc_feature (225)..(225): n is a, c, g, or t
tcagtgatacgtctcacgaccggtgctcgatttagcgagacgcgcagggtcctggcccagtctgccctgactcagcctcctccgcgtccggtctcctggacagtcggtcaccatctcctgcactggaaccngcagtgacattggtntacttaataacctgttgttcctaccgtggtaaccaacgacgccacccaggcaaaccgtcccaaactcgatcgtatttancgaggtcaatacggccgtccgtcgtcggggtccctagtattccggtctttccgtccgtaggtcccttaccgaaacggttccgtacggactaaccccgacccgggtccccttccccggtagtcccttacgttcgaccggtccgttccgaaggtccacggaaaccgtggtaaaccgggtcggttctttaccgggttaaagtttaaccttaccggttacggcgttaaaccgcccgtaacttaaccggttacgccgtaccgaaccccgggtttacccaacccggtaacggttaacctttaacgggtcccggggttttaaaccgaacggggttaccgggaaccgttccggttacccgtaacccgtaccgtaccggttaccccggtaccgacccgtaacccgttaccaacccgttacgtcggtaaccctaacccgttcccgttaacccggttcccccgtcccttaacccggacgttaaacccggtcggtttaaacccacgttccggttaaaccggggccgtttacccgggggcccctttaacgggaaaaccggtttcccgggaacccgtttacccgggtaaagcggggtttccctaccggttaaacgtcccggttacggtccgtaaccggtttacccgtacccgtaccgtaccggtacgtaccgtacg

SEQ ID NO: 42664 - DNA, 733 bp, Homo sapiens
  misc_feature: GYAE6OF02IABQR.9.9.A09.1.454.CMB.1.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
  modified_base (723)..(723): a, c, t, g, unknown or other
  misc_feature (723)..(723): n is a, c, g, or t
  modified_base (726)..(727): a, c, t, g, unknown or other
  misc_feature (726)..(727): n is a, c, g, or t
  modified_base (730)..(731): a, c, t, g, unknown or other
  misc_feature (730)..(731): n is a, c, g, or t
tcagtgatacgtctcacgaccggtgctcgatttagcgagacgcgcagggtcctgggcccagtctgtgctgacgcagccgccctcaggtgtcctcggggccccagggcagagggtcaccatctcctgcacgtggggagcagcctccaaacgagtacggggaaacttccgacttagtgttttgtaacctacgttcgggtaacccgagcctagtcttaccgaaggaaccaccgtaccccccaaaacccctntacgtccttaagtgttaaactagtaacctcccggtccctacggtacggggtcccctaggacccgttattccttcgtcggaccttcctaagttccgcggtcctaccctcgtaccgccccgttccccncggccacgttccgacgtcgggtccttacgcggctacggaggtacgtggacggtcttagtagtttacttacgtcgtacccactttactacgtaacgacgtacgaccgtacggaccgttagggaacggttacggtttagggtcgggtttacggtttccggggacggggtaccggtaacggtaccggtacgtacggtaccgttccggtacggttaccgaccggtccgaccgccggtccctccccgttcgtccgtcttaccgttcccgttcccgtcccttcgtaccgtacgtacgtacgtacgtacgtcggtcgtcggtacgtcgaccggacggacgtcgacgtagcgtagcncgnncgnngc

SEQ ID NO: 42665 - DNA, 630 bp, Homo sapiens
  misc_feature: GYAE6OF02JII83.9.9.A09.1.454.CMB.1.raw
  modified_base (143)..(143): a, c, t, g, unknown or other
  misc_feature (143)..(143): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(630): a, c, t, g, unknown or other
  misc_feature (628)..(630): n is a, c, g, or t
tcagtgatacgtctcacgaccggtgctcgatttagcgagacgcgcagggtcctgggcccagtctgtgctgacgcagccgccctcagtgtctggggccccagggcaggagggtcaccatctcctgcacgtgggagcagctcaanactcgggaatcgctatgttcgtacactggtaccagcagcttcaggaacacgtaccccaaaccctcgatctatacggtaatagtaacgtccggccctacgacggggtcccctacgaccgtattccgtccgttacgggccttaccgtaaacggtcgtcggacctacccgtaccgaccgtccccttcccgtcggacctactacccgacggttcgggacctttcgaggtcgtacggagtatacggacgtcttaacgtaatttacgtactcgaccctactccgtatacggactacggactacgtaccgtagaagttaagtcggtacgttacggtcggacggtaacggacgtacgcgtacgtaccgtcggtacgtcacggacctacggtcctaccgtcccgtacgtcaccgtccgtcctcccgaccgttcacgtacgacttcgtacctagcgtacgcgcgtcgaacgcgacgnacgtncgnacngcncncnnn

SEQ ID NO: 42666 - DNA, 814 bp, Homo sapiens
  misc_feature: GYAE6OF02GQ3SM.9.9.A09.1.454.CMB.1.raw
  modified_base (204)..(204): a, c, t, g, unknown or other
  misc_feature (204)..(204): n is a, c, g, or t
  modified_base (801)..(801): a, c, t, g, unknown or other
  misc_feature (801)..(801): n is a, c, g, or t
  modified_base (811)..(811): a, c, t, g, unknown or other
  misc_feature (811)..(811): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctnatctatggtaaatagtaatcggccctcgacggggttccctgaccgtattcctcgttggcctccgaagtctggcctacctcgaacgtccccttacccgtgggaccctaagttcctaacggtcggggtacctttaccgaacgggtaccgttacggaaggtacgttagggaaccgggtccttaaggttaaacgttttaacgtttacccgttacggcccctttaaacccgttcccgttttaaagaccggaaacccttacgggaccctaaacggtcccgttaaagggtaacggtaaagggttcggtttaggggttaaccgtttacccggggacggggtaacggggtaaaccctaacgggtcgttacggtacccggtttacccgtaggggtacctaaccgggtaccccaacgggttcccgtacccggtcccccgttaccgggttacccaaccgtttcccgttacccggtttccccccgttaccccgttacctacccgtaaccggtaaccgttacctaccgtaacccgtggtaaccgggacccgggttacgttacgggaccgtaaccggggtcccgtaacgtacggtaagtcgtacgacgttanccgtactcgnagc

SEQ ID NO: 42667 - DNA, 781 bp, Homo sapiens
  misc_feature: GYAE6OF02GI7P1.9.9.A09.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
  modified_base (431)..(431): a, c, t, g, unknown or other
  misc_feature (431)..(431): n is a, c, g, or t
  modified_base (771)..(771): a, c, t, g, unknown or other
  misc_feature (771)..(771): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcacgtgggagcagctccaacatcggaatcgctatgtgtacnctggtaccagcagctcagganacgcccaacctcatctagtggtaatagtaatccggaccctgacgggtccctgaaccgacttctccgtggtccctaccgaaagttccgaggtcccaacgttccgaaccgtccctcccggtacggacccttaatcccgtacggtcgggtacctttacgagggtacctgggtaaaccgtaggttggaaccggttgttaaaattcgttttaaaattcgtaccggtaccccttacctaacccggtttaaanacggaaccggtacgtaccgtaacgtcggtaaggtaacgggttagtttacgggtacggtttacggtaccggggaacggggaaccggtaacccgtacgtaccgtaccggtaccggtacggttaacggtacccgacggtaccccggaaccggttccgttaccccgtacccccggtaccggtaccttaccggttcccgttacccgttaccccgtccccgtaacccggttaccgtaaccgtaccggttaaccgttaccgtacgggtaccgggacccgggttacgggtacggtacgaccggaacccggtaccgtaaggtcgtaacgacgtacgcggacgtacggcncgtagagacg

SEQ ID NO: 42668 - DNA, 677 bp, Homo sapiens
  misc_feature: GYAE6OF02IDY89.9.9.A09.1.454.CMB.1.raw
  modified_base (406)..(406): a, c, t, g, unknown or other
  misc_feature (406)..(406): n is a, c, g, or t
  modified_base (665)..(665): a, c, t, g, unknown or other
  misc_feature (665)..(665): n is a, c, g, or t
  modified_base (674)..(674): a, c, t, g, unknown or other
  misc_feature (674)..(674): n is a, c, g, or t
tcagtgatacgtctcacgaccggtgctcgatttagcgagacgcgcagggtcctggcccagtctgtgctgacgcagcccgccctcagtgtctggggccccagggcaggagggtcaccatctcctgcacgtgggagcagcctaccaacagtacgggaatcgactatgttagtactactggtaccagcagcttccaggacacgtaccccaaaccctcatctagtaggtaatagtaactccggacccgtacgacggggtcccctggtaccgtacttcgtcgtcggtcctaccgtaagttccgtcggacctaccgtcgacgtcccctaccgtcgacctaacgtctaccggtcgggtaccttcggacggtcgtaggacgtgttacgggacgtctagttaatttacgttaccncgacctacttctagtcacgctacgtaacgccgttagaagtgtttcggtggttaacgtcgggacggtacggaactacggtccgtacggtacccgtcggtagcccgaacggacccgtacgacccgttccgacccgttcgtactcccgttccacccgtttaccccaccttaccgacgtaaccggttcgttaacctacgtaccgtaggccggtacggttaccgacggtacggtaccggtccgacgtaaggtccaagctagtcngattcgatntcg

SEQ ID NO: 42669 - DNA, 726 bp, Homo sapiens
  misc_feature: GYAE6OF02IQKNH.9.9.A09.1.454.CMB.1.raw
  modified_base (168)..(168): a, c, t, g, unknown or other
  misc_feature (168)..(168): n is a, c, g, or t
  modified_base (177)..(177): a, c, t, g, unknown or other
  misc_feature (177)..(177): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (724)..(724): a, c, t, g, unknown or other
  misc_feature (724)..(724): n is a, c, g, or t
tcagtgatacgtctcacgaccggtgctcgatttagcgagacgcgcagggtcctgggcccagtctgtgctgacgcagccgccctcagtgtctcggggccccagggcagagggtcaccatcctcctgcactgggagcagctccaacagtcgggaatcgctatgttgtacnctggtaccngcacgacttccaaggaacacgtcccccaaaaccctnaagtactntaggtaactagtaacgccggacctcgtacgggtcctgaaccgtatctcgtcgactaccgaacgttcgtggacctaccgtcacgtcccgtaaccgtcggctaacttcgaacccgtggtaccttacgagtccgttagacggtactagggaggtaccttaggttaaactttaacgttactaccggtccctaaagtttacccctaaggtaaccggtaaccaagggttcccaaagtcccgtaggaaagttaaaccgttgggttacgtacgttccggggaagggtaacggaaccgtaaggcgtaccggaccgtaccgtaacggtcgtaaccgccgaaacggtcccgtaccgtcccccggtacgtaccgtaacccgttcgtccccgttccccgacccgtacctacgttaaccgaccgtaacgttccgtaacgtacggaacgtacgggtacctacggttaaccggacgcctaacccgttagaaccggtagtccgaagcaggcacgtacganag

SEQ ID NO: 42670 - DNA, 776 bp, Homo sapiens
  misc_feature: GYAE6OF02JEK5C.9.9.A09.1.454.CMB.1.raw
  modified_base (246)..(246): a, c, t, g, unknown or other
  misc_feature (246)..(246): n is a, c, g, or t
  modified_base (416)..(416): a, c, t, g, unknown or other
  misc_feature (416)..(416): n is a, c, g, or t
  modified_base (762)..(762): a, c, t, g, unknown or other
  misc_feature (762)..(762): n is a, c, g, or t
  modified_base (775)..(775): a, c, t, g, unknown or other
  misc_feature (775)..(775): n is a, c, g, or t
tcagtgatacgtctcacgaccggtgctcgatttagcgagacgcgcagggtcctgggcccagtctgtgctgacgcagccgccctcagtgtctggggccccagggcagagggtcaccatctcctgcactgggagcagctccaacattcgggaatcgacttatgttgtaccacgttggtaacccagccaagccttaccgaaggaacctacgtacccccaaaaccctcactctaatcggtaatagtaacnccggaccctcgacggggtccctagaccgtacttcgtacgtcggccttaccgaagtcgtcggacctaacccgtaccggtcccttacccctcggaccctaaattccggaccggtcgggtacctttacggaacggggtccctagggtaaacggtacgttcggggtaaccggtnttaacggttaacgtttacgtttaaccgtcgaaccccttaccgtacctaacgtacgagtaaccgtacccgtatccgtagtaagggttaaacggttgggtttaccggtaggttaccggggaaccgggtacggaacccggtaaggtcccgtacggtaccctaccggtaacggttaccgaaccggtacccgtaacggtcccgttaccggaccccccggttcgtaccgtaacccgttccttacccgttacccctaccccgttactaccgaaccgttaactacgtacgttaccgtacggtaccggcgggtaccggtcgaacggtaccggcggtacaagtgacgactggaccncgtagcgtacgtnc

SEQ ID NO: 42671 - DNA, 748 bp, Homo sapiens
  misc_feature: GYAE6OF02F6ZIC.9.9.A09.1.454.CMB.1.raw
  modified_base (726)..(726): a, c, t, g, unknown or other
  misc_feature (726)..(726): n is a, c, g, or t
  modified_base (745)..(745): a, c, t, g, unknown or other
  misc_feature (745)..(745): n is a, c, g, or t
tcagtgatacgtctcacgaccggtgctcgatttagcgagacgcgcagggtcctgggcccagtctgtgctgacgcagccgccctcagtgtctggggcccccagggcagagggtcaccatctcctgcactgggagcagctccaacatcgggaatcgctatgttgtacacgtggtaccagcagccttccgaggaacacgtacccccaaacccctcatactatggtaatagtaacgtccgaccctcgacgggtccctgaccgtattctactggctaccagtctgctacctcacggtccctccgtggaccctactccgtaacgtggggtccttacgacggtccgtggaagtagtcggaggtcttacgtatttacgtaccgtgaccccgtacttaccgtaagtcgaaccgtagacccgagttacccgtggtaaacggtaacggttggtaagggtttacccgtaggggaccggggtaacgggtaacccgaggtaccggtccggtaacccggttacccgttacgggacccggtaccggtacccgacgggtcccgttaccccggacccccgttccgggtaccccttacccgtttcccgtttaccccgttacccccccgtaacccggtttaccccgtacctaacggttaacccggttactaaacccgttccggaacgggttaccgggccgggttaccgtaccgggaacggttaccggaccgggactaacggtacgngcacggtccagtgactacncgc

SEQ ID NO: 42672 - DNA, 584 bp, Homo sapiens
  misc_feature: GYAE6OF01CMB2W.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggagaataaaaaattttacgcagactccgtgaaggccgattcaccatctccagacgacccttccaaccatacgctgtatctaccaaatgaaacatggtgacagttagaagacacggacaaactttattattagtgacgaaagtatttcggttggttacgagcaatcaatgtaggatagggtggctcgacaccgtggggaccagggaacacgtggtcaccgtctcctcacgccctaccaccgaacgggccccattcccgggttccctttcccccccgtggcccctaccccttccctacccgaaacgacgccctaacccgg

SEQ ID NO: 42673 - DNA, 563 bp, Homo sapiens
  misc_feature: GYAE6OF01DER9U.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaaattttacgcagactccgtgaaggccgattcaccatctcagacgacccttccaaccatacgctgtatctaccaaatgaacatggtgacagttagaagacacggcaaacttattattgtgacgaaagtatttcgttggttcgagcatcaatgtggatagggtgctcgacaccgtggggccagggaacacgtggtcaccgtctcctcacgccctcccgaccgaacgggccccagttcccggtcccttccccccgtggccctacccctaccctacccaaacgcgccctacccg

SEQ ID NO: 42674 - DNA, 680 bp, Homo sapiens
  misc_feature: GYAE6OF01CYIVS.31.14.B03.1.454.CMB.1.raw
  modified_base (258)..(258): a, c, t, g, unknown or other
  misc_feature (258)..(258): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggctgagcgtggtttcgtcgtagctctttaagaggtgtcagtgtcaggtgcacctggtggaatcgtgggggaggcgtggtccggccgaggggggtcctgagactctcctgtgccatgtctgcgtctgaattcatcctcaggcactatggcatgcacgtggggtccgccagggccccagggcaaaggggctgggagtgggtgctattttanacaatttgatggaagtaattaaaaaatttcgacagactcgtagaagggcattcaccatctccagacacccttccaacatacgctgtatctacaaatgaacagtggtanactaagttagaaagacacggactaaactttattaattgtagacgtaaaagtgtttcggttaggttacgagtacctaatacgtaaagttggtagggtaagttacgggggtgccttacggaaccgtacccgggtaggggggacccaaagggggtaacctaccggttcgggtaccctaacccggtttcctcccttacgacggacccctacccgaaacccggtaaacggggcccctaacggttcccgggttccccccttcccccggtggaccccttacccccttcccgacccgaaacggaccgtccctaaaccccggg

SEQ ID NO: 42675 - DNA, 559 bp, Homo sapiens
  misc_feature: GYAE6OF01B75PF.31.14.B03.1.454.CMB.1.raw
  modified_base (258)..(258): a, c, t, g, unknown or other
  misc_feature (258)..(258): n is a, c, g, or t
  modified_base (478)..(478): a, c, t, g, unknown or other
  misc_feature (478)..(478): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggctgagcgtggtttctcgttagctctttaagaggtgtccagtgtcaggtgcacctggtggaatctgggggaggcgtggtccggcctggggggtccctgagactctcctgtgccatgtctgcgtctgaattcatcctcaggcactatggcatgcactggggtccgccagggcccccagggcaaggggactgggagtgggtggcattttanacaatttgatggagaataaaaaattttacgcagactccgtgaagggccgattcaccatctccagacgacccttccaaccatacgctgtatctaccaaatgaacatggtgacagttgaagacacggctaacttattattgtgacgaagtatttcgttggttcgagcatcaatgtggtatagggtgctcgacaccgtgggccaagggaaactggtcacgtcnctcacgcctccaccgaacgggccctagtcggtcccttcccccgnggcccacccctccctaccaagtcgcctaccgtccggg

SEQ ID NO: 42676 - DNA, 635 bp, Homo sapiens
  misc_feature: GYAE6OF01DD785.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaatttacgcagactcgtgaaggccgattcacatctccagacgaccttccaacatacgctgtatctacaaatgaacatggtagacagttagaagacacggctaacttattattgtagacgaaagtattcggttgttacgagtcatcaatgtaggtagtagggtcgcgtcgacgaccggtggggacccgaagggacctacgttcggtacccgtaccgttcctacccgtacgaccgtaccccgtacccaacccggaaacccgggtcccctaaggttcccccggtttccccctttccccccggtccgggtaccccctaacccccgttaccccctaacccggaacggtaccgccccttaaccccggg

SEQ ID NO: 42677 - DNA, 584 bp, Homo sapiens
  misc_feature: GYAE6OF01EX0VZ.31.14.B03.1.454.CMB.1.raw
  modified_base (212)..(212): a, c, t, g, unknown or other
  misc_feature (212)..(212): n is a, c, g, or t
  modified_base (472)..(472): a, c, t, g, unknown or other
  misc_feature (472)..(472): n is a, c, g, or t
tcagcagtagacgtcacgaccggtgctcgatttagtgtgagtagtttgggctgagcgtggtttcgtcgtaggctctttaagaggtgtccagtgtcaggtgcacctggtggaatctgggggaggcgtggtccggcctggggggtccctgagactctcctgtgccatgtctgcgtctgaattcatcctcaggcatatggcatgcactgggtccnccaggccccaggcaagggactgggagtgggtggcattttatacaatttgatggagaataaaaaatttgcagactcgtgaaggccgattcaccatctccagacgacccttccaaccatacgctgtatctaccaaatgaacatggtgaacagttagaagacacggctaacttattattgtgacgaaagtatttcggttggttcgagtcatcaagtgtggagttagggtgcttacggacaccgtgggggcccaaggggaaccncgttcggtccacccgtttctcctcacgtccctaccgaaccgaacgggccctagtcccggttccttccccccgtggacccctacccctcctaccctaacggcgccctacccgg

SEQ ID NO: 42678 - DNA, 549 bp, Homo sapiens
  misc_feature: GYAE6OF01CFT8V.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaaatttcgcagactccgtgaagggccgattcaccatctccagacgacccttcaaccatacgctgtatctcaaatgaacatggtgacagttgaagacacggacaaactttattattgtagacgaaagtatttcgttggttcgagcatcaatgtggatagggtgctcgacaccgtgggccagggaacacgtggtcaccgtctcctcacgcctccaccgaacgggccccatccggtccttccccccgtggccctacccctcctaccaaacgcgcctacccg

SEQ ID NO: 42679 - DNA, 561 bp, Homo sapiens
  misc_feature: GYAE6OF01EJMP0.31.14.B03.1.454.CMB.1.raw
  modified_base (214)..(214): a, c, t, g, unknown or other
  misc_feature (214)..(214): n is a, c, g, or t
  modified_base (402)..(402): a, c, t, g, unknown or other
  misc_feature (402)..(402): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactgggagtgggtgcatttatacaatttgatggagataaaaaattttcgcagactccgtgaagggccgattcaccatctccagacgacccttccaaccatacgctgtatctccaaatgaacatggtagacagttgaagacacggctaacttattattgtgcgtaaagtnttcgttggttcgagcatcaatgtaggatagggtgctcgacaccgtgggcagggaacncgtggtcaccgtctcctcagcctccaccgaacgggtccccaagttcccggtcccttccccccgtggcccctacccctccctaccgaaacgtcgccctacccg

SEQ ID NO: 42680 - DNA, 562 bp, Homo sapiens
  misc_feature: GYAE6OF01DTPL6.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaaggccgattcaccatctccagacgacccttcaaccatacgctgtatctccaaatgaacatggtgacagttgaagacacggacaaacttattattgtgacgtaaagtatttcgttggttacgagcatcaatgtaggatagggtgctcgacaccgtggggccagggacacgtggtccaccgtctcctcacgccctccaccgaacgggccctatccggttccctttcccccgcggtaccctacccccttaccctacccaacggcgcctacccg

SEQ ID NO: 42681 - DNA, 534 bp, Homo sapiens
  misc_feature: GYAE6OF01BEJ33.31.14.B03.1.454.CMB.1.raw
  modified_base (505)..(505): a, c, t, g, unknown or other
  misc_feature (505)..(505): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgaaagttgaagacacggcaacttatattgtgcgaaagattcgttggttcgagcatcaatgtggatagggtgctcgacacctggggccagggaacacgtggtcaccgtctcctcagcctccaccaagggccccatccggtcttcccccnggccaccctcctccaagcgccaccgtcgg

SEQ ID NO: 42682 - DNA, 558 bp, Homo sapiens
  misc_feature: GYAE6OF01E3KCJ.31.14.B03.1.454.CMB.1.raw
  modified_base (255)..(255): a, c, t, g, unknown or other
  misc_feature (255)..(255): n is a, c, g, or t
  modified_base (480)..(480): a, c, t, g, unknown or other
  misc_feature (480)..(480): n is a, c, g, or t
tcagcagtagacgtcacgaccggtgctcgatttagtgtgagtagtttgggctgagcgtggtttctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggccccaggcaaggggactgggagtgggtggcatttanactaatttgatggagaataaaaaattttacgcagactccgtgaagggccgattcaccatctccagagacccttccaaccatacgctgtatctaccaaatgaacaatggtagacagttgaagacacggcaacttattattgtgacgaaagtattcgttggttcgagcatcaatgtggatagggtgctcgacaccgtgggccgagggaacacgtggtcacgtctccncacgcctaccaccgaacgggccctagtccggtcccttcccccgtggcccaccccgtcctacccaagtcgcctacccgg

SEQ ID NO: 42683 - DNA, 584 bp, Homo sapiens
  misc_feature: GYAE6OF01CI2NP.31.14.B03.1.454.CMB.1.raw
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggctgagctgggtttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggccaagggactggaggtgggtggcatttatacaatttgatggagataaaaatttacgacagactccgtgaacgggccgattcaccatctccagacgacccttccaaccatacgctgtatctacaaatgaacatggtnactagttgaagacacgganaacttattattgtagacgaaagtattcgttaggttcgagtcaatcaatgtagggataggggtgcgtcggacacccggtggggacccaagggaaccacgtgggtccaccgttcnccctcacgccctacccgacaacgggcccctagtcccggttcccttccccccgtggcccctaccccctccctacccaaggcgcccgtacccg

SEQ ID NO: 42684 - DNA, 560 bp, Homo sapiens
  misc_feature: GYAE6OF01ACGDM.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaatttcgcagactccgtgaaggccgattcaccatctccagacgacccttccaaccatacgctgtatctaccaaatgaacatggtagacagttgaagacacggactaacttattatgtagacgaaagtatttcgttaggttcgagtcaagtcaaagtgtaggatagggtggctcgacaccgtgggccagggacacgtggtcaccgttctcctcacgccctaccgaccgaacgggcccagtccggtccttacccccgtggccctaccctcctacccgaagtcgccctaccg

SEQ ID NO: 42685 - DNA, 600 bp, Homo sapiens
  misc_feature: GYAE6OF01CQNS5.31.14.B03.1.454.CMB.1.raw
  modified_base (257)..(257): a, c, t, g, unknown or other
  misc_feature (257)..(257): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaaggggactgggagtgggtggcattttanacaatttgatggagaataaaaaattttacgcagactccgtgaagggccgattcaccatctccagacgacccttccaaccatacgctgtatctaccaaatgaacatggtgacagttgaagacacggactaaacttattattgtagacgaaagtntttcgttggttcgagcatcaatgtggatagggtgctcgacacgtggggaccagggaacacgtggtcacccgtctcctcacgccctaccgaccgaaacgggcccctaagttcccgggttacccctttcccccccgtgggtaccccctacccccgttaccccgttacccaaaacggtccgccctaaccccgg

SEQ ID NO: 42686 - DNA, 658 bp, Homo sapiens
  misc_feature: GYAE6OF01CPGYG.31.14.B03.1.454.CMB.1.raw
tcagcagtagacgtcacgaccggtgctcgatttagtgtgagtagtttgggctgagctgggttttcctcgtgctcttttaagtaggtgtccagtgtcaggtgcacctggtggaatctgggggagggcgtggtccggccgtggggggtccgtgagactctcctgtgccatgtctgcgtctgaattcatcctcaggcactatggcatgcactgggtccgccaggccccaggcaagggactggaggtgggtggctatttatacaatttgatggagaataaaaaatttacgcagactcgtgaaggcgattcaccatctccagacgacccttaccaaccaataccgctagtatactaccaaatagaacagtggtgaacagttagaagaaccacggacaaactttattaattgacgtacgaaagtatttcggttacggtttcgaagtacctaatacaagttggtgggtaagttagggggtgacttccggaagacccgtgggggacccaaggggtaaccgaacgtcgggttaccaacccggtttcctacccgtcaacggtcccctacccgaacccgaaaacggggtcccccaagttcccgggttcccctttacccccccgtcgggaccctacccccgttccctacccgaaacgcgcccggtacccc

SEQ ID NO: 42687 - DNA, 550 bp, Homo sapiens
  misc_feature: GYAE6OF01AKON6.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagataaaaattttacgcagactccgtgaagggccgattcaccatctccagagacccttccaaccatacgctgtatctccaaatgaacatggtgacagttgaagacacggcaaacttattattgtgacgaaagatttcgttggttcgagcatcaatgtggagtgggtgctcgacaccgtgggccagggacacgtggtcaccgtctcctcacgcctccaccgacgggccctagtccggtccttcccccgtcggccctacccctccctaccaacgcgccctacccgg

SEQ ID NO: 42688 - DNA, 576 bp, Homo sapiens
  misc_feature: GYAE6OF01C56HC.31.14.B03.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatcgtgggggaggcgtgggtccggcctggggggtccctgagactctcctgtgccatgtctgcgtctgaatttcatcctnaggcactatggcatgcactgggtccnccaggccccaggcaagggctgggagtgggtgnatttatacaatttgatgganaattaaaaaatttacgcagactcgtgaaggccgattcacatctcagacgacccttcaaccatacgctgtatctacaaatgaacatggtnacagttanaagacacggacaacttattatgtgacgtaaagtatttcgttggttacgagtcaatcaagtgtaggagtagggngctcgacgacgtggggaccagggacacgtgtacaccgtctcctacacgtccctccgaaccgaacgggccccagttcccggttcccttccccccgtggacccctaccccctacctacccaaacgccgtccgtaccccgg

SEQ ID NO: 42689 - DNA, 584 bp, Homo sapiens
  misc_feature: GYAE6OF01CN2FV.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccaggccccaggccaagggactggagtgggtgcattttanacaatttgatggagaattaaaaatttacgcagactcgtgaaggccgatcaccatctccagacgacccttccaaccatacgctgtatcctacaaatgaacatggtanactagttagaagacacggctaaacttattatgtagacgtaaagtnttcgttggttcgagtcaatcaagtgtaggtatagggtgctcgacgaccgtggggaccaagggaacacgtggtaccaccggtcctccgacgacgccctaccgaaccgaacggggcccctagtcccggttccttccccccgnggccctaccccctcctaccgaacggcgtcgtaccccgg

SEQ ID NO: 42690 - DNA, 547 bp, Homo sapiens
  misc_feature: GYAE6OF01COB2I.31.14.B03.1.454.CMB.1.raw
  modified_base (432)..(432): a, c, t, g, unknown or other
  misc_feature (432)..(432): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtgcatttatacaatttgatggagataaaaaatttacgcagactccgtgaaggccgattcaccatctccagacgaccttccaaccatacgctgtatctccaaatgaacatggtgacagttgaagacacggcaaacttatatgtgacgaaagtattcgttgttcgagcatcaatgtggatagggtgctcganaccgtggggaccagggaacacgtggtccaccgtctccctcagtccctaccaccgaacgggccccaagtcccggtcctttcccccnggcccacccctcctacccaagcgctacccg

SEQ ID NO: 42691 - DNA, 750 bp, Homo sapiens
  misc_feature: GYAE6OF01B1Z9E.31.14.B03.1.454.CMB.1.raw
tcagcagtagacgtcacgaccggtgctcgatttagtgtgagtagtttagggtttacgggggagcttacaaccaggacaaggccagggggcagcaagatggtgttgccagacccgaggtcgttccagtttcgttcctgtttgcgtcgtggatctctggtagccgtacggggaccatccgtggatgaagccgagtttccagtactccgtggctagtgtcctctacgggtcggacgacggggccaaccctactcgaactcggcctaagtccgaagccagagttcgttttattcggaccccaaccaattaaccaaactacgttagccttcggtaccacgacgaagaaaggtaggacagccgtacctaaacgtccgtagtattactcggtctttcgtacccgggcacgttccggggttacctaaccgacttacagttcggtccgagcgggtactcggggaccgtacgtttcgactacgtccaacctagttaccacgacctacgtcccttagaccgaacggtcttagggaaacgttacgtttaggtaacgggtacccgtaagggtttttaaccttaaccggttcccgttactaaacggtaccctaaaccgttaagtttaacgtttaaccgtttcccggttttacccgttaacccgtacggttttcccgggaccgggtaacgggaccgtaacggggtggtacgtacgtacgaaacgtacgttgggcgacgtacgctacgattcgtctcgttctaccg

SEQ ID NO: 42692 - DNA, 570 bp, Homo sapiens
  misc_feature: GYAE6OF01EPKRG.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggctgagcgtggtttcgtcgtaggctctttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggactggagtgggtgctatttanacaatttgatggagtaataaaaatttacgacagactcgtagaaggccgattcacatctccagacgacccttccaaccatacgctgtactctaccaaatgaacatggtanactagttgaagacacggactaaacgttattattgtagacgtaaagtatttcgttggttacgagctatcaagtgtaggagtagggtgctacgacacgtgggaccagggaacacgttggacctaccgtctccctcgacgccctccgaaccgaacgggccctagtccggttcccttcccccgngccctacccctctaccaagcgctacccgg

SEQ ID NO: 42693 - DNA, 626 bp, Homo sapiens
  misc_feature: GYAE6OF01C9EY1.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccnccaggccccaggcaagggctggagtgggtggcatttatacaatttgatggagaataaaaaatttcgcagactccgtagaaggcgattcaccatctccagacgacccttaccaaccatacgctgtatctaccaaatgaacatggtgacagttgaagacacggacaaacttattattgtagacgtaaagtatttcgttggttccgagtactatactaagtggtaggtagtaggggtcgactcgacgaccgtgggggacccaaggggaaccacgttcgggtacctacccgttctccctcgacgccctacccgaacccgaacggggccccctaaggttccccgggttccctttcccccccgtgggtaccccctaccccccgttccctaccccgaaacgtaccgtcccgtaaccccgg

SEQ ID NO: 42694 - DNA, 547 bp, Homo sapiens
  misc_feature: GYAE6OF01EC4PN.31.14.B03.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctaccaaatgaacatggtgacagttgaagacacggcaacttattattgtgacgaaagatttcgttggttcgagtcatcaatgtggatagggtgctcgacaccgtgggccagggacacgtggtcaccgtctcctcacgcctccaccaacgggccccagtccggtccttccccccgnggcccacccctccctaccaagcgcctacccg

SEQ ID NO: 42695 - DNA, 584 bp, Homo sapiens
  misc_feature: GYAE6OF01CUUMZ.31.14.B03.1.454.CMB.1.raw
  modified_base (252)..(252): a, c, t, g, unknown or other
  misc_feature (252)..(252): n is a, c, g, or t
  modified_base (496)..(496): a, c, t, g, unknown or other
  misc_feature (496)..(496): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgataggagaataaaaatttacgacagactccgtgaaggccgattcaccatctccagacgacccttacaaccatacgctgtatctacaaatgaacatggtagacagttgaagacacggactaaacttattactgtagacgtaaagtatttcgttaggttcgagtctatacaagtggtaggagttagggtggcgtcgacgaccgtggggaccaagggaacacgtggtacaccgtctccncacgtccctaccgaccgaacgggccccaagttcccggttcccttccccccgtggccctaccccctcctacccgaacgcgcctacccgg

SEQ ID NO: 42696 - DNA, 568 bp, Homo sapiens
  misc_feature: GYAE6OF01ESLH6.31.14.B03.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagcagtagacgtcacgaccggtgctcgattttagtgtgagtagtttagggtttagggggagcgtaccaacaggctaggctacggggccacgcaagatggtgttgcagacccgaggtcttcaagtttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcagaaagtaggacagcctacctaaactcctgatttactgggcttcgtacccgggnagtccgggttcctaacgnttcattcgcagcggtctgggaccgtatttcgactctcaccatcagcagccctgcaggctagaacgtatgtggctagttttatactgtcagcaacattatacttctttcgtctacgtttcggcgggtaggacccgaagggttggagtaactacgaaaaccgtattggtcggacttcgacctaccgaattccgttagttccttgtaccc

SEQ ID NO: 42697 - DNA, 579 bp, Homo sapiens
  misc_feature: GYAE6OF01BCRMX.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (356)..(356): a, c, t, g, unknown or other
  misc_feature (356)..(356): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagataaaaatttcgcagactccgtgaaggccgattcaccatctccagacgacccttcaaccatacgctgtatctaccaaatgaacatggtnacagttgaagacacggactaacttattattgtagacgtaaagtattcgttggttcgagcatcaatgtgatgggtgctcgacncgtggggccagggaacncgtcggtcacccgttctccgtacacgccctacccgaaccgaacgggtccccagttcccgggtccctttacccccccgtgggaccctacccccttcccgaccccaaacggtccgcctaaccccgg

SEQ ID NO: 42698 - DNA, 831 bp, Homo sapiens
  misc_feature: GYAE6OF01ARJHH.31.14.B03.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggctgggagctagggttttccgtcgttgctcttttaagagggtgtccacgtcgtcagggtcgcgacctggtggaacttcgtcgggggacggtccgtggttcccggcccgtcggggggtccctggaaggacctcctccggtcgtggcccatgtctcgcgtctgaattccatcctcaggcacgtntcggcatgcactcgggccgcacggccccaggccaaagggactacggagtcgggtggctaagttttagtaacgtaaattttgaactttcggaacgtaagtaaaaaaacttttacggaccaacgaacgtccgtagaaccggaccgattcaccattctccaggacgacccttccaaccactaccgctggtactcgtaccaaatcgaactatcggtgactacgttgaacgtacacgggacaaacgttacgttacttcgtagaccgtaaagtactttcggtttgggttccgtacgacgtacgtacggaaagttgggttaggtaagttaacggggtttaggtaccgtttacgggaacctacccggtttacggggggaccctaagggggtaaacccgtaccgggttacgggtaccgtaacccgggttccgtaccccggttacggtaacggtccccggttaccccggaaaccccggaaaccgggggtcccccgtaaacggtttccccggggttaccccgttttcccccccggtaggggtaccccctaaccccccgtttaccccggtaccccgtaaaccgggtacccccggtccgttaaaccccccggg

SEQ ID NO: 42699 - DNA, 548 bp, Homo sapiens
  misc_feature: GYAE6OF01CGH14.31.14.B03.1.454.CMB.1.raw
  modified_base (480)..(480): a, c, t, g, unknown or other
  misc_feature (480)..(480): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagataaaaaattttacgcagactccgtgaagggccgattcaccatctccagacgacccttccaaccatacgctgtatctaccaaatgaacatggtgacagttgaagacacggactaaacttattattgtgacgaaagtattcgttggttcgagcatcaatgtggagtagggtgctcgacaccgtgggccagggaacacgtggtcaccgtctccncagccctccaccgaacgggcccagtccggtccttcccccgnggcccaccctcctccaagcgctacccg

SEQ ID NO: 42700 - DNA, 558 bp, Homo sapiens
  misc_feature: GYAE6OF01CETM7.31.14.B03.1.454.CMB.1.raw
tcagcagtagacgtcacgaccggtgctcgatttagtgtgagtagtttgggctgagcgtggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaaatttacgcagactccgtgaagggccgattcaccatctccagacgacccttccaaccatacgctgtatctaccaaatgaacatggtgacagttgaagacacggcaacttattattgtgacgaaagtatttcgttggttacgagcaatcaatgtggagtagggtgctcgacaccgtggggaccaggggaacacgtggtacaccatctcctcgacgtccctccaaccgaacgggcccacgttccggtccttcccccgtggcccaccccttccacccaagccgacccg

SEQ ID NO: 42701 - DNA, 572 bp, Homo sapiens
  misc_feature: GYAE6OF01EGZUB.31.14.B03.1.454.CMB.1.raw
  modified_base (252)..(252): a, c, t, g, unknown or other
  misc_feature (252)..(252): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagaataaaaaattttacgcagactccgtgaagggccgattcaccatctccagagacccttccaaccatacgctgtatctaccaaatgaacatggtgacagttgaagacacggctaaacttattattgtagacgaaagtattacgttggttcgagcatcaatgtggatagggtgctcgacnccgtggggccagggacacgtggtccacgtctcctcacgccctcccaccaacgggccctattccgggtccctttccccccgtcggtaccctacccccttacccgtaccccaaggaccgccctaacccgg

SEQ ID NO: 42702 - DNA, 546 bp, Homo sapiens
  misc_feature: GYAE6OF01BKBP1.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (358)..(358): a, c, t, g, unknown or other
  misc_feature (358)..(358): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaaattttacgcagactccgtgaaggccgattcaccatctccagagacccttccaaccatacgctgtatctaccaaatgaacatggtnacagttgaagacacggactaacttattattgtagacgaaagtattcgttggttcgagcatcaatgtggatagggtgctcgacaccgtggggccaggggaacacgtggtcaccgtctcctcagcctccacgaacgggcccatccggtccttccccctggaccctaccctccctaccaacgcgctacccg

SEQ ID NO: 42703 - DNA, 548 bp, Homo sapiens
  misc_feature: GYAE6OF01A33IQ.31.14.B03.1.454.CMB.1.raw
  modified_base (360)..(360): a, c, t, g, unknown or other
  misc_feature (360)..(360): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcattttatacaatttgatggagataaaaaattttacgcagactccgtgaagggccgattcaccatctccagagacccttccaaccatacgctgtatctccaaatgaacatggtnacagttgaagacacggcaacttattattgtgacgaaagtatttcgttggttcgagcatcaatgtggatagggtgctcgacaccgtggggccagggacacgtggtcaccgtctcctcagccctccaccgaacgggcccagtccggtccttcccccgtggccctacccctcctacccaagcgcctacccg

SEQ ID NO: 42704 - DNA, 582 bp, Homo sapiens
  misc_feature: GYAE6OF01CVG7M.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaaggccgattcaccatctcagacgacccttccaaccatacgctgtatctacaaatgaacatggtgacagttgaagacacggactaacttattattgtgacgaaagtagtttacgttggttcgagtctatacaattgtaggagttagggtggtcctacgaccaccgtggggaccaggggaaccacgtcggtaccaccgtcctcctcacgccctccacccgaacgggccccagttcccggtcccttaccccccgtcggcccacccccttcccacccaaacgcgcctaccccg

SEQ ID NO: 42705 - DNA, 570 bp, Homo sapiens
  misc_feature: GYAE6OF01D3MJX.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggctgagcgtgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaatttcgcagactccgtgaaggccgattcaccatctccagacgacccttccaaccatacgctgtatctaccaaatgaacatggtagactagttagaagacacggactaaacttattattgtagacgtaaagtagttcgttaggttcgagctatacaagttgtaggtagtagggtgctcgacaccgtggggaccagggacacgtgtccacgtctccncagccctaccaccgaacgggccctagtccggttcccttcccccgtggcccctacccctccctaccaacgccgccgtacccg

SEQ ID NO: 42706 - DNA, 547 bp, Homo sapiens
  misc_feature: GYAE6OF01BJ5K0.31.14.B03.1.454.CMB.1.raw
  modified_base (214)..(214): a, c, t, g, unknown or other
  misc_feature (214)..(214): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaatttacgcagactccgtgaagggccgattcaccatctccagacgacccttccaaccatacgctgtatctaccaaatgaacatggtgacagttagaagacacggcaaacttattattgtagacgaaagtattcgttggttcgagcatcaatgtggatagggtgctcgacaccgtggggccagggacacgtcggtcaccgtctcctcacgcctaccaccgaacgggcccagtcccggtccttccccncggcctaccctccaccacgcgcctacccg

SEQ ID NO: 42707 - DNA, 551 bp, Homo sapiens
  misc_feature: GYAE6OF01BDX85.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagataaaaattttacgcagactccgtgaagggccgattcaccatctccagacgacccttccaaccatacgctgtatctccaaatgaacatggtgacagttgaagacacggcaacttattattgtgacgtaaagtattcgttggttcgagcatcaatgtggatagggtgctcgacaccgtggggccagggaacacgtcggtcaccgtctcctcacgcctccaccgaacgggcccagtccggtccttcccccgtggccctacccctccctaccaacgcgcctacccg

SEQ ID NO: 42708 - DNA, 550 bp, Homo sapiens
  misc_feature: GYAE6OF01EUXZQ.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (446)..(446): a, c, t, g, unknown or other
  misc_feature (446)..(446): n is a, c, g, or t
  modified_base (478)..(478): a, c, t, g, unknown or other
  misc_feature (478)..(478): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttanacaatttgatggagaataaaaaattttacgcagactccgtgaagggccgattcaccatctccagacgacccttccaaccatacgctgtatctccaaatgaacatggtgacagttgaagacacggctaaacttattattgtgacgtaaagtattcgttggttacgagcatcaatgtggatagggtgctcgacnctggggccagggacacgtgtcaccgtctctcngccctccaaccacgggcccagtccggtccttccccccnggaccctacccgtcctacccaacgcgccctaccg

SEQ ID NO: 42709 - DNA, 583 bp, Homo sapiens
  misc_feature: GYAE6OF01BNILV.31.14.B03.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagcagtagacgtcacgaccggtgctcgatttagtgtgagtagtttgggctgagctggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccacggccccaggcaagggactgggagtgggtgcatttanacaattgatggagataaaaatttcgcagactcgtgaaggccgattcaccatctccagagacccttcaaccatacgctgtatcaccaaatnaacatggtgacagttnaagacacggactaacttatattgtgacgaaagtnttcgttggttacgagtcatcaagttgtaggtagtagggtgctcgacaccgtggggaccaggggaactacgtgggtccacccgtctcccgtcgacgccctccaccgtaacgggcccctaggtccggttcccttccccccgtcgggtacccctaccccgttccccgtaccaaccggtcgaccccgtaacccgg

SEQ ID NO: 42710 - DNA, 596 bp, Homo sapiens
  misc_feature: GYAE6OF01CVASQ.31.14.B03.1.454.CMB.1.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagcagtagacgtcacgaccggtgctcgatttagtgtgagtagtttgggctgagcgtggtttcctcgttgctcttttaagaggtgtccagtgtcaagtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggnggcatttanacaatttgatggagataaaaaattttacgcagactccgtgaagggccgattcaccatctccagagacccttcaaccatacgctgtatctacaaatgaacatggtnacagttgaagacacggacaaacttattaatgtgacgtaaagatttcgttgggttcgagctatcaagttgtaggagtaggggtgccttacggacctaccgtggggccaggggaacacgttcggtctaccgtcgtcctacgacgtccctcccgaccgaaccgggcccctaagttcccggttacccttccccccgtggccctaacccccgttccctaccgaaacggcgtcccgtaaccccgg

SEQ ID NO: 42711 - DNA, 559 bp, Homo sapiens
  misc_feature: GYAE6OF01ANMCQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggactggagtgggtggcatttatacaatttgatggagataaaaattttacgcagactccgtgaagggccgattcaccatctccagacgacccttccaaccatacgctgtatctaccaaatgaacatggtgacagttgaagacacgcaacttattattgtgacgaagtattcgttggttcgagcatcaatgtaggatagggtgctcgacaccgtgggccagggaacacgtggtccacgtcctcctcacgccctaccacccgaacgggcccagttccggtcccttccccccgtcggaccctacccccttcccacccaacgcgcctacccg

SEQ ID NO: 42712 - DNA, 710 bp, Homo sapiens
  misc_feature: GYAE6OF01ECDOT.31.14.B03.1.454.CMB.1.raw
  modified_base (256)..(256): a, c, t, g, unknown or other
  misc_feature (256)..(256): n is a, c, g, or t
  modified_base (438)..(438): a, c, t, g, unknown or other
  misc_feature (438)..(438): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccaggccccaggcaagggactggagtgggtggctatttanactaatttgataggaagaattaaaaaattttacgacagactccgtagaagggccgattcaccatctaccagacgacccttaccaaccatacgctgtactctaccaaatacgaaactagtaggtagaacgtagttagaacgacgaacggtactaaactttattagttagtagaacgtaaagtnttacgttaggttacgatacgatactaagtgtaggtaagtacggggtgccgttaccggaacgtacccgggtacgggggacccgtaacggggaacctaccggttacggtacccgtacccggttaccctacccgtaccaccggtacccctaccccgaaccggtaaccggggtcccctaacggttcccccgggttaccccttcccccccggtacgggtacccccctacccccttaccccgtacccgaaaccggtacccgtccccgtaacccccggg

SEQ ID NO: 42713 - DNA, 1097 bp, Homo sapiens
  misc_feature: GYAE6OF01EMIJT.31.14.B03.1.454.CMB.1.raw
tcagcagtagacgtcacgaccggtgctcgatttagtgtgagtagtttgggtcgttggagctgggttttcctcgttgctcgttttaagaggtgtccagtgtcaggtgcgacctcggtggaatctgggggacggcggtggttccggcctgggggtccctgaggactctccgtgtcgaccatgtctgcgtctgaattccatcctccacgccactatggcattgcacgtgggtaccgccacggcccccaggccaaggggtacgtcggggacgtaggggttcggacgtaacgtttttacgtaccgttaaatttttaggttaaagtttggggtaaaggtaaacttaaaaaaaaagttttttaccggaaccgtaaaacggtaaccggttaccccggttaccggtaaacgggggaccccggtaacttttaccgaacccctaacgttccctttaccccgtaaacggtaaccggttaacccccgtttttaccccaaaacccctttaacgtttaacccggtaccgttttacgggttttaaccggtttaccccttaaccctaaaaacgtttaacggtaaaacccgtaagtttacgggggttacggtaaaccggtttaagggtttttaacgggaaaacggggtaaaccgtaaaccgggggtaacctttaaaacccgttttaaacgtttttaaacgttttacggtttaacggtaaccggttaaaaaggttaacgttttaccgggttttaggggttttacccgtaacggtacccgttaaacgttaccgtaaaaagtttgggtttaagggttaagtttaacgggggttacggttacccgtttacggtaacccgtaacccggttacgggggaacccgtaacgggggtaaacccgtaccgggtttacccgggttaccgttaaccccggttaccgtttacccccggtacccggtaaccggtaccccgttacccccggtaaacccggtaaacccggggtaccccccttaacggttaccccgggtttcccccgtttacccccccggttacgggtacccccgttaccccccgttaccccgtaaccccgaaaccggttacccgtccccgttaaccccggg

SEQ ID NO: 42714 - DNA, 548 bp, Homo sapiens
  misc_feature: GYAE6OF01AL4RP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaattttgatggagataaaaaattttacgcagactccgtgaagggccgattcaccatctccagagacccttccaaccatacgctgtatctccaaatgaacatggtgacagttgaagacacggcaacttattattgtgacgaagattcgttggttcgagcatcaatgtggatagggtggctcgacaccgtggggccagggaacacgtggtcaccgtctcctcacgcctccacccgaagggccccatccggtccttccccccgtggcccaccccttcctaccaacgcgctacccg

SEQ ID NO: 42715 - DNA, 589 bp, Homo sapiens
  misc_feature: GYAE6OF01EDXOC.31.14.B03.1.454.CMB.1.raw
  modified_base (252)..(252): a, c, t, g, unknown or other
  misc_feature (252)..(252): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatgagaataaaaatttacgcagactccgtgaaggccgattcaccatctccagacgacccttccaaccatacgctgtatctaccaaatgaacagtggtagacgtagttagaagacgacggactaaacttatttattgtagacgaaagtattcggttggttacgagcatcaagtgtaggagtaggggtgctcgacnccgtgggaccgagggaacncgtggtccaccgtcctcctcgacgccctacccaccgtaacgggcccctagttcccgggttcccttaccccccgtggacccctacccctcccctaccaaacggccgcccgtaacccg

SEQ ID NO: 42716 - DNA, 570 bp, Homo sapiens
  misc_feature: GYAE6OF01BH5RQ.31.14.B03.1.454.CMB.1.raw
  modified_base (363)..(363): a, c, t, g, unknown or other
  misc_feature (363)..(363): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagaataaaaaattttacgcagactccgtgaagggccgattcaccatctccagacgacccttccaaccatacgctgtatctaccaaatgaacatggtnacagttgaagacacggctaaacttattattgtgacgaaagtatttcggttggttcgagcatcaatgtggagtagggtgctcgacaccgtggggccaagggaacacgtggtccaccgtctcctcacgccctaccacccgaacgggcccctaagtcccggttcccttcccccgtggccctacccctccctacccaacgcgccgtacccg

SEQ ID NO: 42717 - DNA, 563 bp, Homo sapiens
  misc_feature: GYAE6OF01B23EE.31.14.B03.1.454.CMB.1.raw
  modified_base (214)..(214): a, c, t, g, unknown or other
  misc_feature (214)..(214): n is a, c, g, or t
  modified_base (358)..(358): a, c, t, g, unknown or other
  misc_feature (358)..(358): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacatttgatggagaataaaaaattttacgcagactccgtgaaggcgattcaccatctccagacgacccttcaaccatacgctgtatctaccaaatgaacatggtnacagttgaagacacggacaactttattattgtacgacgtaaagtagtttcgttgggttcgagtcatacaattgtaggagtaggggtgctacganaccgtggggcccaagggacacgtggccacctctcctcacgcctacccaccgaacggccctagtccggtcccttcccccgtggccctaccctcctaccaacgcgcctacccg

SEQ ID NO: 42718 - DNA, 544 bp, Homo sapiens
  misc_feature: GYAE6OF01A6A5P.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcattttatacaatttgatggagataaaaattttacgcagactccgtgaagggccgattcaccatctccagagacccttccaaccatacgctgtatctaccaaatgaacatggtgacagttgaagacacggactaacttattattgtgacgaaagtattcgttggttcgagcatcaatgtggatagggtgctcgacaccgtgggccagggacacgtggtcaccgtctcctcacgcctccaccgaacgggcccagtccggtccttcccccgtggccctaccctcctaccagcgctaccg

SEQ ID NO: 42719 - DNA, 550 bp, Homo sapiens
  misc_feature: GYAE6OF01CACUF.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagacgacccttccaaccatacgctgtatctccaaatgaacatggtgacagttgaagacacggcaacttattattgtgacgaaagtatttcgttggttcgagcatcaatgtaggagtagggtgctcgacaccgtgggccagggacacgtggcaccgtctcctcacgcctccaccgaacgggccccagtccggtccttcccccgtggccctacccctccctaccaacgcgcctacccg

SEQ ID NO: 42720 - DNA, 568 bp, Homo sapiens
  misc_feature: GYAE6OF01AF5EO.31.14.B03.1.454.CMB.1.raw
  modified_base (252)..(252): a, c, t, g, unknown or other
  misc_feature (252)..(252): n is a, c, g, or t
  modified_base (413)..(413): a, c, t, g, unknown or other
  misc_feature (413)..(413): n is a, c, g, or t
  modified_base (491)..(491): a, c, t, g, unknown or other
  misc_feature (491)..(491): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggctggagtgggtgcatttanacaatttgatggagaataaaaatttacgacagactccgtgaagggccgattcaccatctccagacgacccttaccaaccatacgctgtatctaccaaatgaacagtggtagactagttagaaagaccgacggctaaactttattagttgtagacgaaagtntttcggttgttacgagcatacaagtgtaggagtagggtgctcgacaccgtgggccagggacacgtgtcaccgtctccncacgccctaccaccgaacggccctagtcccggttcccttcccccgnggccctaccccgtccaccacgcgcctacccg

SEQ ID NO: 42721 - DNA, 536 bp, Homo sapiens
  misc_feature: GYAE6OF01A75UO.31.14.B03.1.454.CMB.1.raw
  modified_base (528)..(528): a, c, t, g, unknown or other
  misc_feature (528)..(528): n is a, c, g, or t
tcagcagtagacgtcacgaccggtgctcgatttagtgtgagtagtttgggtcgtgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggcccccaggcaagggactgggagtgggtggcattttatacaattttgatggagataaaaaattttacgcagactccgtgaagggccgattcaccatctccagagacccttccaaccatacgctgtatctccaaatgaacatggtgacagttgaagacacggcaaacttattattgtgcgaaagattcgttggttcgagcatcaatgtggatagggtgctcgacaccgtggggccagggacactggtcaccgtctcctcacgcctccaccacgggcccatcggtccttcccctggccacccctctaccagngctacccg

SEQ ID NO: 42722 - DNA, 610 bp, Homo sapiens
  misc_feature: GYAE6OF01BU6LM.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccgccaggccccagggcaagggactggagtgggtgcatttanacaatttgatggagaataaaaatttcgcagactcgtgaaggcgattcacatctccagacgacccttcaaccatacgctgtatctaccaaatgaacatggagacagttagaagacacggactaaactttattattgtagacgaaagtatttcggttggttacgagtcaatcaaagtgtaggagtagggtgcctcggaacacccggtggggaccaagggaaccacgttcgggtaccacccgttcctacctccgacgtcccctaccgaaacccgaacggggcccctaaggttccccgggttccccttccccccgtacggcccctacccctccctacccaaacggacgccctaaccccgg

SEQ ID NO: 42723 - DNA, 640 bp, Homo sapiens
  misc_feature: GYAE6OF01A243H.31.14.B03.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggcgttggagctgggttttccctcgttgctcttttaagaggtgtccagtgtcagggtcgcacctggtggaatcgtggggggagcgtggtccggcctggggggtccctgagactctcctgtgccatgtctgcgtctgaattccatcctcaggcactatggcatgcacgtgggccncaggcccaggcaagggctggagtgggtgcatttanacgaatttgatggagtaattaaaaaattttacgcaagactccgtgaagggaccgagttcaccgactctccagacgacccttcaaccatacgctgtactctacaaatcgaacatggtanacagttagaagacacggctaactttattagttgtagtacgtaaagtactttacgttaggttaccgagactaagtcgaaagttggtaggtacgtagggtggccttacggtactaaccgtggggaccaaggggaactacgtggtacctaccggttcctcctacgtacgtcccttacccgaaccgtaacggggcccctaagttcccgggttcccttaccccccgtaggacccctacccgtcccgtacccaacggtcgaccctacccgg

SEQ ID NO: 42724 - DNA, 642 bp, Homo sapiens
  misc_feature: GYAE6OF01APARL.31.14.B03.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatctgggggagcgtggtccggcctggggggtccctgagactctcctgtgccatgtctgcgtctgaattcatcctnagcactatggcatgcactggggtccnccaggccccaggccaagggctggagtggggtcgctattttanacctaatttgatggagtaattaaaaaattttacgcagacctccggtagaacgggccgattcgaccagtcctccagacgtacccttaccaacctataccgactcgtaactcctaccaaatacgaactagtgggtacgaactaggttagaacgacaacggacctaaatttattaagttgtagacgtaagtaatttcgggttggttcgagctactactaaagttgtagggtattaaggggtcgcgttcgacgaccgtggggccgaagggaactacgtggtacctccggttcacccttcacgtccctacccgaacccgaacggcccctagtcccggttcccttcccccggtcggccctaccccgttaccctaccgacgacgccgtacccgg

SEQ ID NO: 42725 - DNA, 548 bp, Homo sapiens
  misc_feature: GYAE6OF01A09DA.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaaattttacgcagactccgtgaagggccgattcaccatctccagagacccttccaaccatacgctgtatctccaaatgaacatggtgacagttagaagacacggctaacttattattgtagacgaaagattcgttggttcgagcatcaatgtggatagggtgctcgacaccgtggggccagggaacacgtggtccacgtctcctcagcctccaccgaacggcccagtccggtcccttcccccgtggccctacccctccctaccaacgcgcctacccg

SEQ ID NO: 42726 - DNA, 576 bp, Homo sapiens
  misc_feature: GYAE6OF01EZYRP.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagataaaaattttacgcagactccgtgaagggccgattcaccatctccagacgacccttcccaaccatacgctgtatctaccaaatgaaacatggtgacagttagaagacacggctaacttattattgtagacgaaagtattcgttggttcgagcatcaatgtggagtagggtgctcgacaccgtggggccgagggacacgtggtccaccgtctcctcacgtccctacccaaccgaacgggcccctagtcccggttcccttccccccgtcggacccctacccccttccctacccaacggcgccctacccg

SEQ ID NO: 42727 - DNA, 558 bp, Homo sapiens
  misc_feature: GYAE6OF01BBQMB.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaaacttattattgtgacgaaagattcgttggttcgagcatcaatgtggatagggtgctcgacaccgtggggccagggaacacgtggtcaccgtctcctcagccctccaccgaacgggccccagtccggttcccttccccccgtggccctacccccttccctacccaacgcgccgtaaccccg

SEQ ID NO: 42728 - DNA, 572 bp, Homo sapiens
  misc_feature: GYAE6OF01DG6W8.31.14.B03.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (341)..(341): a, c, t, g, unknown or other
  misc_feature (341)..(341): n is a, c, g, or t
  modified_base (403)..(403): a, c, t, g, unknown or other
  misc_feature (403)..(403): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccnccaggccccaggccaagggactggagtgggtggcatttanacaatttgatggagaataaaaaattttacgcagactccgtgaagggccgattcaccatctcagagacccttcaaccatacgctgtatcnccaaatgaacatggtgacagttagaagaccacggtacaacgtttattattgtagacgaaagntttcgttggttacgagcatcaattgtggatagggtgctcgacaccgtgggccagggaacacgtcggtcaccgtctcctcacgcctaccaccgaacgggccctaagttccggttcccttccccccgtggaccctaccccgttccctacccgaacgacgtcctaaccccgg

SEQ ID NO: 42729 - DNA, 564 bp, Homo sapiens
  misc_feature: GYAE6OF01CCZKG.31.14.B03.1.454.CMB.1.raw
  modified_base (470)..(470): a, c, t, g, unknown or other
  misc_feature (470)..(470): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagtaataaaaaattttacgcagactcgtgaggccgattcaccatctccagacgacccttccaaccatacgctgtatctccaaatgaacatggtgacagttgaagacacggactaactttattattgtagacgaaagtattcgttggttcgagcatcaatgtggagtagggtgctcgacaccgtgggccagggacacgtggtccncgtctcctcacgccctccaccgaacgggcccctagtcccggttcccttccccccgtggcccacccccgttcctacccgaacgngccctacccgg

SEQ ID NO: 42730 - DNA, 713 bp, Homo sapiens
  misc_feature: GYAE6OF01DDCDB.31.14.B03.1.454.CMB.1.raw
  modified_base (288)..(288): a, c, t, g, unknown or other
  misc_feature (288)..(288): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggcccccaggcgaagggactggagtgggtgctatttatactaatttgatggaagaaattaaaaaatttcganagactccgtagaacggcgtatcacatctcagacaccttaccaaccatacgctgtactctaaccaaatacgaaacagtggtagaacgtagttagaaagaccgaacggactaaactttattattcgtagaacgtaaagtagtttcggttaggttacgagtactaatacgtaaagtgggtaggtaaggttaggggtcggtaccgttacggaaccgtacccgggtcggggggaacccgaaagggggtaaaccaccggttacgggtacccgtaacccggttcccttacccgtaccgaaccggtcccccttaccccgaaacccggtaaaccggggccccctaaggttccccgggttacccctttcccccccggaggtaccccctaacccccgttaccctaacccgaaacggtacccgcccttaaccccggg

SEQ ID NO: 42731 - DNA, 694 bp, Homo sapiens
  misc_feature: GYAE6OF01B7XFM.31.14.B03.1.454.CMB.1.raw
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
  modified_base (350)..(350): a, c, t, g, unknown or other
  misc_feature (350)..(350): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggcccaggcaagggctggagtgggtgcatttanacaatttgagtggagtaataaaaaatttcgacagactcgtgaaggccgattcacatctacagacgacccttacaaccatacgctgactactacaaatnaacatggtagactagtagaagacgacggactaaattattagttagtcgaacgtaaagtgtttacggttagttacgagactaatacgaaagttgggtagggtaagttaaggggtcggtaccgttaccggaacgacccgggttagggggaccctaaacggggtaacctaaccggttcggggtacccctaacccgggttcccttacccttccggaaccgtaccccgttacccgaaaccccgggtaaacggggtccccctaacggtttccccgggttccccttccccccgttacgggaccccttaccccgtacccctaccgtaaacggacccgtaccgtaaccccggg

SEQ ID NO: 42732 - DNA, 608 bp, Homo sapiens
  misc_feature: GYAE6OF01AONTC.31.14.B03.1.454.CMB.1.raw
  modified_base (256)..(256): a, c, t, g, unknown or other
  misc_feature (256)..(256): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcattttanacaatttgatggagaataaaaaattttacgcagactccgtgaagggccgattcaccatctccagacgacccttccaaccatacgctgtatctaccaaatgaacatggtgacagttagaagacacggactaaactttattattgtagcgaaagtnttcgttggttacgagcatcaatgtagagtagggtgccgtcgacaccgtgggccgaagggacacgtggtccaccgtctcctcgacgccctacccgaacccgaaccggggccccaggttcccggttacccctttccccccccgtagggtccccctaacccccgttcccttaccccgaaacggtccgtcccgtaaccccgg

SEQ ID NO: 42733 - DNA, 573 bp, Homo sapiens
  misc_feature: GYAE6OF01BUGGB.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcgggcactatggcatgcactgggtccgccaggccccaggcaagggactggagtgggtggcatttatacaatttgatggagaataaaaattttacgcagactccgtgaagggccgattcaccatctccagacgacccttccaaccatacgctgtatctccaaatgaacatgtgacagttgaagacacggacaacttattattgtagacgaaagtattcgttggttcgagcatcaatgtggatagggtgctcgacaccgtggggccagggaacacgtggtcaccgtcctcctcacgccctcccaccgaacgggcccctagttcccggtccttccccccgtcggccctaacccccgtccctacccaaaggccgcccgcccgtacccggg

SEQ ID NO: 42734 - DNA, 568 bp, Homo sapiens
  misc_feature: GYAE6OF01DI0HA.31.14.B03.1.454.CMB.1.raw
  modified_base (214)..(214): a, c, t, g, unknown or other
  misc_feature (214)..(214): n is a, c, g, or t
  modified_base (402)..(402): a, c, t, g, unknown or other
  misc_feature (402)..(402): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttatacaatttgatggagataaaaaattttacgacagactccgtgaagggccgattcaccatctccagacgacccttccaaccatacgctgtatctccaaatgaacatggtgacagttgaagacacggacaacttattattgtgacgaaagnttcgttggttcgagcaatcaatgtggatagggtgctcgacacgtgggaccagggaacacgtggtcaccgtctcctcacgcctaccaccgaacgggcccaagttccgggttccctttacccccccgtggcccctaccccttaccctacccaaacgcgcctaacccgg

SEQ ID NO: 42735 - DNA, 576 bp, Homo sapiens
  misc_feature: GYAE6OF01EQB7H.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaaattttcgcagactccgtgaaggccgattcaccatctccagacgacccttccaaccatacgctagtatctaccaaatgaacatggtgacagttgaagacaacggctaaactttattattgtagacgaaaagtatttcggttggtttacgagtcaatactaatgtggagtagggtgctcgacaccgtggggccagggaacacgtgtccaccgtctcctacactccctaccaaccgaacgggccctagtcccggttccttcccccgtggccctacccctccctacccaagacgcgtaaccccgg

SEQ ID NO: 42736 - DNA, 830 bp, Homo sapiens
  misc_feature: GYAE6OF01A8CG2.31.14.B03.1.454.CMB.1.raw
tcagcagtagacgtcacgaccggtgctcgatttagtgtgagtagtttgggcgttgggagctgggttttcctcgttgctcttttaagaggtgtccagtggtcaggtgcgacctccggtggaatctgggggacggcgggtggtcccggcctggggggtccctgaggactctccgtgtcgaccatgtctgccgtctgaattccatcctccacggccactatggcatgcacgtgggtaccgccacggcccccaggccaaagggtacgtcggggagtaggggtcggactacgttttagtacctaattttgtaaattgggtaagtataaaaaaagttttacgacgaaacgacgtacccggtcgaacggggccgactttcgaccagtcctccaagacgtacccttacctaaccctattacccgcttcggttacgttcctaccaaattaggtaaccagtcgggtgaacgtaggtttcgaaggaacctaccgggacttaaacctttaatttactttcggtaacgtacgtaaaacggatttaccggttagggtttacggtaggtacctaagttaccgtaaagtgggtttacgggtaagttaagggggttacggtacttaccgggtactacccggttacgggggaccaaccgggggtaaaccacccggttaccgggtacctacccggttcccttacccggtaccgaccggtccccttaaccccgaaccggtaaacccggggtacccctaacggttacccgggtccccgtttacccccccggtggggtacccctacccccggttccctaccccgaaacggtaccgttcccgttaaccccggg

SEQ ID NO: 42737 - DNA, 605 bp, Homo sapiens
  misc_feature: GYAE6OF01DGXYM.31.14.B03.1.454.CMB.1.raw
  modified_base (255)..(255): a, c, t, g, unknown or other
  misc_feature (255)..(255): n is a, c, g, or t
  modified_base (404)..(404): a, c, t, g, unknown or other
  misc_feature (404)..(404): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggggaggcgtggtccggccgtggggggtccctgagactctcctgtgccatgtctgcgtctgaattcatcctcaggcactatggcatgcactgggtccgccaggccccaggcaagggactggagtgggtgctatttanacaatttgatggagaataaaaatttcgcagactcgtgaaggcgtatcacatctcagacgacccttaccaaccatacgctgtactctaccaaatgaaacatggtagacagttagaagacacggactaacttattattgtagacgaaagtntttcggttggttacgagtcatacaatggtaggtagtagggtgctcgacgaccgtggggacctaagggaacctacgtcggtaccacccgtctccctacacgccctacccgaaccgaacggggcccctaagttccccggtcccttaccccccggtggacccctaccccctaccctaacccgaaacggacgcccgtaaccccgg

SEQ ID NO: 42738 - DNA, 559 bp, Homo sapiens
  misc_feature: GYAE6OF01C6G3Z.31.14.B03.1.454.CMB.1.raw
  modified_base (464)..(464): a, c, t, g, unknown or other
  misc_feature (464)..(464): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaattaaaaaattttacgcagactccgtagaagggccgattcaccatctccagacgacccttcaaccatacgctgtatctaccaaatgaaacatggtgacagttagaagacacggacaactttattattgtgacgaaagatttcgttggtcgagcatcaatgtggatagggtgctcgacacgtggggaccagggaacncgtggtcaccgtctcctcacgcctaccacgaacgggccccagttcccggtccttcccccgtggccctacccctccctaccaaacgcgcctacccg

SEQ ID NO: 42739 - DNA, 576 bp, Homo sapiens
  misc_feature: GYAE6OF01C50QT.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagaattaaaaaattttacgacagactccgtagaagggccgattcaccatctccagacgacccttccaaccatacgctgtatctacaaatgaacatggtagacagttgaagacacggacaacttattatgtgacgtaaagtattacgttggttacgagtcatacaatgtaggagtagggtgctcgacaccgtggggaccagggaacacgtggcaccgtctcctcacgtccctccgaccgaacgggcccctagttcccggtcccttccccccgtaggcccctaccccttccctaccaacgccgcccgtacccg

SEQ ID NO: 42740 - DNA, 585 bp, Homo sapiens
  misc_feature: GYAE6OF01B3A8V.31.14.B03.1.454.CMB.1.raw
  modified_base (85)..(85): a, c, t, g, unknown or other
  misc_feature (85)..(85): n is a, c, g, or t
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
  modified_base (519)..(519): a, c, t, g, unknown or other
  misc_feature (519)..(519): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggctgagcgtggtttcgcgtaggctctttaagaggtntccagtgtcaggtgcactggtggaatcgtgggggaggcgtggtccggccgtggggggtccctgagctctcctgtgccatgtctgcgtctgaattcatcctgaggctactagtggcatgcacgtggggtcccaccgacgggccccaggcaaggggtactgggagtggggtggctatttatactaagtttgatggaagtaattaaaaaattttcgacagtactccggtgaacgggccattcaccatctcagacgacccttacaaccatacgctgtatctacaaatgaacagtaggtgactagttagaacgacacggtactaacgtttatattgtagacgaaagttntttacggttggttcgagctatacaattggnggtaggtagggtcggctacgacacggtggggaccaagggacacgtggcctaccgtctccncacgtcctccatccgacggccacgtccggtccttccccgngcccctaccctacctcaaggctaccg

SEQ ID NO: 42741 - DNA, 566 bp, Homo sapiens
  misc_feature: GYAE6OF01CZ7OY.31.14.B03.1.454.CMB.1.raw
  modified_base (429)..(429): a, c, t, g, unknown or other
  misc_feature (429)..(429): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaaatttacgcagactccgtgaaggcgattcaccatctcagacgacccttcaaccatacgctgtatctacaaatgaacatggtgacagttgaagacacggcaaacttattattgtgacgaaagatttcgttggttcgagcatcaatgtggatagggngctcgacaccgtggggccagggaacacgtggtcaccgtctcctcacgccctccaccaacggggcccctaagttcccggtccctttccccccgtgggccctacccccgttcctaccccgaaagccgcccgtaaccccg

SEQ ID NO: 42742 - DNA, 571 bp, Homo sapiens
  misc_feature: GYAE6OF01A7RBN.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactgggagtgggtgcatttanacaatttgatggaagaataaaaatttacgcagactccgtgaaggccgattcaccatctccagacgacccttccaaccatacgctgtatctaccaaatgaacatggtgactagttagaagacacggactaacttattattgtagacgtaaagtatttcgttgggttacgagtcaatacaaagtggtaggagtagggtgtctcgacgtacgtggggccaagggacacgtggtccaccgtctcctcacgccctaccaccgaacgggccctagtcccggtcccttccccgngccctaccctcctaccacgcgcctacccgg

SEQ ID NO: 42743 - DNA, 548 bp, Homo sapiens
  misc_feature: GYAE6OF01AL2P3.31.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaagggactggagtgggtgcatttanacaatttgatggagataaaaattttacgcagactccgtgaagggccgattcaccatctccagagacccttccaaccatacgctgtatctccaaatgaacatggtagacagttgaagacacggactaacttattattgtgcgaaagtattcgttggttcgagccaatcaaattggtaggatagggtgctcgacaccgtggggcccaagggacactgggtcaccgtctcctcagcctccaccaagggcccagtccggtccttcccccgnggaccncccctctacccaaagtcgctacccg

SEQ ID NO: 42744 - DNA, 572 bp, Homo sapiens
  misc_feature: GYAE6OF01BV6RO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggctatttatacaatttgatggaagaattaaaaaattttacgcagactccgtgaagggccgattcaccatctccagacgacccttccaaccatacgctgtactctaccaaatgaacatggtagacagttagaagacacggactaacttattattgtgacgaaagtatttcgttggttcgagcaatcaagtgtaggagtagggtgctcgacaccgtggggccagggaacacgtggtccaccgtctcctcacgccctaccgaccgaacgggccctagtccggtcccttcccccgtggccctacccctcctaccgaacgcgcctaacccgg

SEQ ID NO: 42745 - DNA, 542 bp, Homo sapiens
  misc_feature: GYAE6OF01BJASZ.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggccccaggcaagggctggagtgggtgcatttanacaatttgatggagaataaaaatttacgcagactccgtgaagggccgattcaccatctccagacgacccttccaaccatacgctgtatctaccaaatgaacatggtgacagttagaagacacggacaacttattattgtgacgaaagtatttcgttggttcgagcatcaatgtggatagggtgctcgacacgngggccagggacncgtgcacgtctcncncgccctccaccgaacggccctagtccggtcccttcccccgnggccctaccctcctaccaagcgctacccg

SEQ ID NO: 42746 - DNA, 718 bp, Homo sapiens
  misc_feature: GYAE6OF01DYK7G.31.14.B03.1.454.CMB.1.raw
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggcctggggggtccctgagactctcctgtgccatgtctgcgtctgaattcatcctcaggcactatggcatgcacgtgggtcccgccaggccccaggcaagggactggagtgggtgctatttanactaatttgataggaagtaataaaaaatttcgacagactccgtagaaggcgatcacatctccagacgaccctacaaccatacgctagtactctaccaaatagaaacagtggtagaactacggttagaacgacgacggactaaacttagttatagtagacgtaaagttagtttcggttaggttacgagtactaatactaaagtggtaggtagtacggggtcgacgtacggtaaccgacccggtacgggggaccgtaaggggaaccgtaccgttacgggtacccgtaacccggttccctacccgtaccgaaccgtcccccttaacccgaacccggtaaacccgggggtccccctaacggttcccccgggttccccctttaccccccccggttacgggacccccctaacccccccgttcccgtaaacccccgaaacggtacccggtaccccgttaaccccgggg

SEQ ID NO: 42747 - DNA, 593 bp, Homo sapiens
  misc_feature: GYAE6OF01CQKZJ.31.14.B03.1.454.CMB.1.raw
  modified_base (552)..(552): a, c, t, g, unknown or other
  misc_feature (552)..(552): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccagggcccccagggcgaaggggactgggagtgggtggcatttatacaatttgatggagaataaaaaattttacgcagactccgtgaagggccgattcaccatctcagacgacccttccaaccatacgctgtatcctacaaatgaaacatggtagactagttgaaagacacggactaaactttattatgtagacgaaagtattcgttggttcgagtcatacaagtgtaggatagggtggctcgacacgtggggaccaagggaacacgtggtaccaccgttcctcctcacgccctaccaccgaaacgggcccctagtcccggttcccttacccccncgggacccacccccttacctccgaaacgcgcccgtacccgg

SEQ ID NO: 42748 - DNA, 651 bp, Homo sapiens
  misc_feature: GYAE6OF01DARRQ.31.14.B03.1.454.CMB.1.raw
  modified_base (213)..(213): a, c, t, g, unknown or other
  misc_feature (213)..(213): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaagggctggagtgggtggcatttatacaatttgataggaagaattaaaaaattttacgacaagactccgtagaagggccgattcaccatcctccagacgacccttcaaccatacgctgtatctacaaatgaacatggtagacagttagaagacacggtacaacttattattgtagacgtaaagtntttcgttggttacgagtcaatacaatgtggagtagggtgctcgacgaccgtggggaccaaggggaacctacgtcgggtaccacccggttcttccccgtacgaccgtccccttacccccgaaccgaaacccgggggtccccctaaggttccccgggtttccctttccccccccgttaggggaccccctaccccccggttacccttaccccgaaaacgggtaccgtcccctaaacccccggg

SEQ ID NO: 42749 - DNA, 560 bp, Homo sapiens
  misc_feature: GYAE6OF01B0FC9.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggaagaataaaaaattttacgcagactccgtgaagggccgattcaccatctccagacgacccttccaaccatacgctgtatctccaaatgaacatggtgacagttgaagacacggctaaactttattattgtgacgaaagtattcgttggttacgagcatcaatgtaggtatagggtggctcggacaccgtggggccagggacacgtggcaccgtctcctcagcctccaccgacgggcccagttccggtcccttcccccgtggcccaccccttcccaccaacgccgcgtaccccg

SEQ ID NO: 42750 - DNA, 582 bp, Homo sapiens
  misc_feature: GYAE6OF01D3I7W.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (502)..(502): a, c, t, g, unknown or other
  misc_feature (502)..(502): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactggagtgggtgcatttanacatttgatggagaataaaaatttcgnagactcgtgaaggccattcaccatctccagacgacccttccaaccatacgctgtactctaccaaatgaacatggtagactagttagaagacacggactaacttattattgtagacgtaaagtactttcggttggttacgagtacaatacgaattggtaggtagttaggggtcgctacgacaccggtgggaccaagggactacgtggtaccaccgtctccacncgccctccgaacgacgggccctagtcccggtcccttcccccgtggcccctaccccgtcctaccgaacgcgccctacccgg

SEQ ID NO: 42751 - DNA, 552 bp, Homo sapiens
  misc_feature: GYAE6OF01A9LIM.31.14.B03.1.454.CMB.1.raw
  modified_base (535)..(535): a, c, t, g, unknown or other
  misc_feature (535)..(535): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttatacaatttgatggagaataaaaattttacgcagactccgtgaagggccgattcaccatctccagacgacccttccaaccatacgctgtatctccaaatgaacatggtgacagttagaagacacggacaacttattattgtagacgaaagtatttcgttggttcgagcatacaatgtaggatagggtggctcgacaccgtggggaccagggacacgtcggtcaccgtctcctcacgccctccaaccgacgggcccatccggtccttcccccgtggccctaccccnctacgacncgcctccgg

SEQ ID NO: 42752 - DNA, 569 bp, Homo sapiens
  misc_feature: GYAE6OF01A7PKF.31.14.B03.1.454.CMB.1.raw
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (406)..(406): a, c, t, g, unknown or other
  misc_feature (406)..(406): n is a, c, g, or t
  modified_base (490)..(490): a, c, t, g, unknown or other
  misc_feature (490)..(490): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcactgggtccgccaggccccaggcaagggactggagtgggtgctatttanacatttgatggagaataaaaatttacgcagactccgtgaagggccgattcaccatctccagacgacccttccaaccatacgctgtatctaccaaatgaacagtggtgacagttagaacgacacggactaacttatttattgtagacgtaaagtntttcgttggttcgagctatcaatggtaggagtagggtgctcgacaccgtgggaccgaaggacacgtggtccaccgtctcctccngtccctaccaccgacgggcccagtcccggtcctttcccccgnggcccctacccctcccaccgaacgcgcccgtacccgg

SEQ ID NO: 42753 - DNA, 734 bp, Homo sapiens
  misc_feature: GYAE6OF01AV3JZ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagtaataaaaatttacgacagactccgtgaagggccattcaccatctccagacgacccttccaaccatacgctgtatctaccaaatgaacagtggtagacagttgaagacacggactaaacttattattgtagacgtaaagtagtttcggttagggtttacgaaggtacctaatccgtaaaagttgggttacgggaagttaaggggggttacgggtacccgttaccggaacgtaaaccccggttgggggggacccctaaacggggggaaaccctaaccgttcggggttacccgaaccccggttccgttacccctccgaaccggtccccttaccccgaaaccccggtaaccgggggccccctaacggttaccccggggttcccccttttcccccccccggttagggcccccctaaccccccttaccccgttaccccgaaaacggtaacccggtcccgttaaaccccccgg

SEQ ID NO: 42754 - DNA, 567 bp, Homo sapiens
  misc_feature: GYAE6OF01E5NCY.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaaggccgattcaccatctccagacgacccttccaaccatacgctgtatctaccaaatgaacatggtgacagttgaagacacggctaaacttattattgtagacgaaagtatttcgttggttcgagcatcaatgtggatagggtgctcgacaccgtggggccaagggacacgtggtccaccgtctccctcacgccctcccgaaccgaacgggccccagttcccggtccctttccccccgtggcccctacccctccctacccaacggcgccctacccg

SEQ ID NO: 42755 - DNA, 747 bp, Homo sapiens
  misc_feature: GYAE6OF01DLIMB.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccaggccccaggcaagggctggagtgggtgcattttanacatttgatggagtaattaaaaattttacgacagactcgtaggaagggcgtattcaccatctccagacacccttaccaaccatacgctagtactacctaccgaaatagaaactagtaggtagaacgtagttagaacgaacgacggactaaactttattattcggtagtaacgaaaaggttctttacggttagggtttacgagtactaacgtactaaagtgggtagggtaaggttaggggtggtaccttaccggaaccgtaaccgggttcggggggacccgtaacggggtaaacctacgggttacggtaccctacccggttaccgtacccgttaccgacggtacccccgtaaccccgaaaccccggtaacccgggggtccccctaacgggtttcccccgggttaccccctttcccccccggttaccgggacccccttaccccccgttaccccgtaaccccggaaaccgtaccggtaccccgttaaccccggg

SEQ ID NO: 42756 - DNA, 572 bp, Homo sapiens
  misc_feature: GYAE6OF01BQTLL.31.14.B03.1.454.CMB.1.raw
  modified_base (405)..(405): a, c, t, g, unknown or other
  misc_feature (405)..(405): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccccgagactctcctgtgccatgtctgcgtctgaattcatcctcaggcactatggcatgcactgggtccgccaggccccaggcaagggactggagtggggtggcatttatacaattttgatggagaataaaaaattttacgcagactccgtgaagggccgattcaccatctccagagacccttccaaccatacgctgtatctaccaaatgaacatggtgacagttgaagacacggacaacttattattgtagacgaaagtnttcggttggttcgagtcaatcaatgtaggatagggtgctcgacaccgtggggccagggaacacgtggtccaccgtctcctcacgccctaccgaccaacgggccccagttcccggtcccttccccccgtggcccctacccctccctacccaagcgcccacccgtcggg

SEQ ID NO: 42757 - DNA, 716 bp, Homo sapiens
  misc_feature: GYAE6OF01C86ZN.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtcccgccaggcccccaggcaagggactgggagtgggtggcattttatacaatttgatagggaagtaaattaaaaaatttcgacagactccgtaggaacggccgtattccaccatcctccagacgtaccccttaccaaccatacgctgtactcctaccaaatacgaaactagtagggtacgacgtagttagaaagtacgacggtaactaactttatttagtgtagaacggtaaagtgtttacgggtttggttacggagtctaattaactaagttgggtagggtaaggttaggggtcggtccttacggaaccctaccgggtcgggggaacccgaaggggaacctacgttcggtaccctacccgtttcctccctaccgaccgtacccctaccccgaacggtaacccgggtcccctaaccgtttccccgggttaccccctttccccccggtcggaaccccctacccccgttaccccgtacccgaaacggtcccgcccgttaaccccggg

SEQ ID NO: 42758 - DNA, 565 bp, Homo sapiens
  misc_feature: GYAE6OF01EH8T6.31.14.B03.1.454.CMB.1.raw
  modified_base (261)..(261): a, c, t, g, unknown or other
  misc_feature (261)..(261): n is a, c, g, or t
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactggggtcccgccaggcccccaggcaaaggggctgggagtggggtggctattttanactaatttgatggagaataaaaaatttacgcagactcgtgaagggccgattcaccatctccagacgacccttaccaaccatacgctagnaatactccaaaaatgaacatggtgacaagttgaaagacaacggtntaaacttattatgtagcgtaaagtattcgttggttcaagcatcaatgtgggatagggtggctcggacgacctggggaccagggaacactggtcacccgtctcctcacgcctaccgaccaagggccccactcccggtcttccccctcgtccaccctacctccaacgcgtcg

SEQ ID NO: 42759 - DNA, 601 bp, Homo sapiens
  misc_feature: GYAE6OF01DHBGH.31.14.B03.1.454.CMB.1.raw
  modified_base (373)..(373): a, c, t, g, unknown or other
  misc_feature (373)..(373): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (589)..(589): a, c, t, g, unknown or other
  misc_feature (589)..(589): n is a, c, g, or t
tcagcagtagacgtcacgaccggtgctcgatttagtgtgagtagtttgggctgtagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactgggagtgggtggctatttataacaattttgatggaagaattaaaaaattttacgacagactccgtgaagggccgattcaccatctccagacgacccttccaaccatacgctgtatctaccaaatgaacatggtanacagttgaagacacggactaacttattattgtagacgtaaagtatttcgttggttacgagctaatcaagtgtggatagggtgctcgacnccgtggggaccagggaacncgtggtaccaccgtctccgtacacgccctaccgaaccgaacggcccctaagttcccgggtcccttcccccgtggacccctaccccgttaccctacccgaacggtaccncccgtaacccgg

SEQ ID NO: 42760 - DNA, 552 bp, Homo sapiens
  misc_feature: GYAE6OF01B1SX9.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagataaaaaatttacgcagactccgtgaagggccgattcaccatctccagacgacccttccaaccatacgctgtactctaccaaatgaacatggtgacagttagaagacacggactaactttattattgtgacgaaagtattcgttggttcgagcatcaagtgtaggagtgggtgctcgacaccgtggggccaagggacncgtggtccaccgtctcctnacgcctccgaccacgggccctagtccggtcctcccccgtgccctaccctccaccaacgcgcctaccgg

SEQ ID NO: 42761 - DNA, 638 bp, Homo sapiens
  misc_feature: GYAE6OF01DKH9P.31.14.B03.1.454.CMB.1.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagcgtggtttctcgttgctcttttaagaggtgtccagtgtcaggtgcacctggtggaatcgtgggggaggcgtggtccggcctggggggtccctgagactctcctgtgccatgtctgcgtctgaatttcatcctcaggcacttatggcatgcactggggtcccnccaggccccaggcaagggctggagtgggtgctatttanacaatttgatggaagtaattaaaaattttacgcagtactccgtaggaagggccgattacacctatctaccagacgacccttaccaaccatacgctgtactcctaccaatcggaacagtggagactagttagaagacacggactaactttattagttgtagacgtaaagtactttcggttagggttcgaagctaatcgaagttggtggtaagttaggggtgtccgttcggaacctaccgggttgggggacccaggggaacctacgtcggttccaccgttctaccgtcaccgtcccacccgaccgaacgggtcccctagttcccgggtcccttccccccgtggacccctacccccgttaccctaccaaacgccgtctaaccccgg

SEQ ID NO: 42762 - DNA, 555 bp, Homo sapiens
  misc_feature: GYAE6OF01CQTUV.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaatttcgcagactccgtgaaggccgattcaccatctccagacgacccttcaaccatacgctgtatctacaaatgaacatggtagacagttagaagacacggacaacttattatgtgacgtaaagtattcgtttggtcgagcatacaatgtggatagggtgctcgacacgtgggccagggacacgtggtcaccgtctcctcacgcctaccgaccgaacgggcccctagttcccggtccccttcccccgtggccctaccccttcctaccaaacgcgcctacccgg

SEQ ID NO: 42763 - DNA, 660 bp, Homo sapiens
  misc_feature: GYAE6OF01BWEXN.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccaggccccaggcaagggactgggagtgggtggctagtttatacaatttgataggaagtaattaaaaaattttcgacagactccgtaggaacgggtccattcaccatcctaccagacgacccttacaaccatacgctgtactctacaaatcgaacagtggtagacgtagttgaacgacacggtactaaacgtttattattgtacgtacgtaagtagtttcggttggttacgagtctatacgtaagtgtaggtagttagggtcggtcctacggacaccggtggggaccgtaaggggacctacggtcggtacctacccggtctccgtacgacgtacccctacccgtaaccgaccgggtcccctagttccccgggtcccctttccccccgtacggacccctaccccccgtccctaacccgaacggtacccgtcccgtaaccccggg

SEQ ID NO: 42764 - DNA, 811 bp, Homo sapiens
  misc_feature: GYAE6OF01BTO82.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttatacaatttgatggagaataaaaatttcgacagactccgtagaaggccgattcaccatctccagacgacccttaccaaccataccgctagtactctaccaaatcgaacagtggtagacaggttacgaaagacgacggactaaactttattagttgtagtacgtaaagtacgtttcggttaggttacgagtacaagtactaaagtgggttaggtaaggttagggggttacggtaccgttaccgggaacccgtacccgggttacggggggaaccccgtaaggggggtaaaccctacccgggtttaccgggggttaaccccttaacccccgggtttacccgttaccccgttacccggtaaccgggttaccccccgttacccccgaaacccccgggtaaacccggggggtacccccccttaaccgggtttcccccggggttttcccccccttttaccccccccccgggttcggggtaacccccccccttaaccccccggtttacccccccgttaaccccggtaaaacccgggtaacccggtacccccgttaaacccccccggggg

SEQ ID NO: 42765 - DNA, 596 bp, Homo sapiens
  misc_feature: GYAE6OF01BFB17.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccgccacggcccccaggcaaggggactgggaggtgggtggctattttatactaattttgatggaagtaattaaaaaaattttacgacaagactccgtaggaacgggccgattcaccatcctccagacgaccccttaccaaccatacgctgtactctaccaaatgaacatggtagactagttagaaagacacggactaacttattattgtagacgtaaagtatttcggttaggttcgagtcatcaatggtaggagtagggtgctcgacaccgtggggacagggacacgtggtcaccgtctcctcacgccctccgaaccgacgggcccctagtcccggtcccttcccccgtgccctacccctcctaccaacgcgccgtacccg

SEQ ID NO: 42766 - DNA, 629 bp, Homo sapiens
  misc_feature: GYAE6OF01DQGSI.31.14.B03.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggctgagcgtggtttcgtcgtagctctttaagaggtgtccagtgtcaggtgcacctggtggaatcgtgggggagcgtggtccggcctggggggtccctgagactctcctgtgccatgtctgcgtctgaattcatcctcaggcactatggcatgcacgtcggggtccnccacggccccaggccaaaggggctgggagtgggtgctatttanacgaatttgatggaagaataaaaatttcgcagactccgtagaaggccgattcaccatcctccagacgacccttccaaccatacgctntactctacaaatagaacagttgganacgagttagaagacacggctaaacttattattggtgacgaaagtgtttacgttcggttacagtcatacaagttgtaggaagtagggtgtcctacgacgccggtggggacccgaagggactacgtcggtaccgacccgttccgtcctacacccggtaccctacccgaaccggaaaccgggcccctacgttcccgggttaccccttccccccgtagggccccctacccccgtaccaccgaaaccggtcgccctaccccggg

SEQ ID NO: 42767 - DNA, 559 bp, Homo sapiens
  misc_feature: GYAE6OF01AUIO5.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaatttacgcagactccgtgaaggccgattcaccatctccagacgacccttccaaccatacgctgtactctaccaaatgaacatggtgacagttgaagacacggctaaacttattattgtagacgtaaagtatttcgttggttacgagctatcaaatggtaggagttagggtgctcgacaccgtggggaccagggaacncgtggtcaccgtctcctcacgcctaccgaccgaacggccctagtccggtccttcccccgtgccctaccctccaccaacgcgccgtacccg

SEQ ID NO: 42768 - DNA, 551 bp, Homo sapiens
  misc_feature: GYAE6OF01CV6XJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagacgacccttccaaccatacgctgtatctccaaatgaacatggtgacagttgaagacacggcaaacttattattgtgacgtaaagattcgttggtcgagcaatcaatgtggatagggtgctcgacaccgtggggccagggaacacgtggtcaccgtctcctcacgccctccaccaacgggccccagtccggtccttcccccgtggccctacccctccctaccaacgcgcctacccg

SEQ ID NO: 42769 - DNA, 570 bp, Homo sapiens
  misc_feature: GYAE6OF01BRWK1.31.14.B03.1.454.CMB.1.raw
  modified_base (253)..(253): a, c, t, g, unknown or other
  misc_feature (253)..(253): n is a, c, g, or t
  modified_base (461)..(461): a, c, t, g, unknown or other
  misc_feature (461)..(461): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaatttcgcagactccgtgaagggccgattcaccatctccagacgacccttccaaccatacgctgtatctaccaaatgaacatggtgacaggttgaagacacggactaacttattattgtgacgaaagatttcgttggttcgagcatcaatgtaggagtagggtgctcgacaccgtggggccagggaacncgtggtcaccgtctcctcacgccctccaccgaagggcccctagtcccgggttcccttccccccgtgggcccctaccccgttccctacccgaaacgtcgccctaccccgg

SEQ ID NO: 42770 - DNA, 582 bp, Homo sapiens
  misc_feature: GYAE6OF01DZSK8.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactggagtgggtgctatttanacaatttgataggaagaattaaaaaattttacgacagtactccgtaggaagggccgtattcaaccatctaccagacgacccttaccaaccatacgctgtactctacaaatgaacatggtagacagttagaagacacggactaacttattattgtagacgtaaagtnttacgttggttacgagcaatcaagtgtggatagggtgctacgacaccgtgggaccgaagggacacgtcgtccaccgtctccgtcacgtcctccacgaacgggccctagtccggtcccttcccccgtggacccctaccctacctaccaacgcgccgtacccg

SEQ ID NO: 42771 - DNA, 691 bp, Homo sapiens
  misc_feature: GYAE6OF01BH3G2.31.14.B03.1.454.CMB.1.raw
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccaggccccaggcgaagggactgggagtgggtgctatttanacaatttgatggaagtaattaaaaaattttacgacagactccggtagaacgggccgattcaccatctcagacacccttccaacatacgctgtactctaccaaatcgaaactagtggtagaacgtagttagaagaacgacggactaaacttattattggtagtacgtaaagtagtttacggttggttacgagtactaatacgtaaagttggtaggtaagtaggggtcgtactacggaacgtacccgggtagggggaccgaacggggtaacctacggttcgggtaccctacccgggttacttaccccgacgtaaccggtcccctaacccgtaaacccggaccgggtcccctacggttacccgggttccccttaccccccggtgggaccccccttaccccttacccgtaaccccaagggtacccgccctaacccgg

SEQ ID NO: 42772 - DNA, 536 bp, Homo sapiens
  misc_feature: GYAE6OF01AWKV4.31.14.B03.1.454.CMB.1.raw
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttagggtttgggggagcgtacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttcctacccgggcacgtcccggggttacctaaccgattcattggcagcgggtctcgggaccatttcactctcaccatcagcacgcctgcgagctagaagntgtggctagtttatacgtntcagcaactattactactttcttcgtactacgtttcggacggtagggacctaaggtgagtatacgaaacgtatggtgctgcacctatctgtctctac

SEQ ID NO: 42773 - DNA, 717 bp, Homo sapiens
  misc_feature: GYAE6OF01DV1PR.31.14.B03.1.454.CMB.1.raw
  modified_base (177)..(177): a, c, t, g, unknown or other
  misc_feature (177)..(177): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggtaatcgtgggggaggcgtggtccggcctgggggtccctgagactctcctgtgccatgtctgcgtntagaattcatcctcaggcactatggcatgcacgtcgggtcccaccaggccccaggacgaagggactgggagtgggtggctagtttanactaagtttgagtaggaagaattaaaaatttcgacagactcgtagaaggcgtatcacatctcagacgaccttaccaacatacgctagtactctaccaatacgaactagtcggtagacgtaagttaggaacgacgaacggactaaacgtttatttaagttggtacgtaacggtaaagttacgtttcggtttaggttacgagtactagtactaaagttgggtaggtaagttaggggtaggtccgttaccggaaccgtaccgggtacgggggtaaccgaaggggtaacctacgggttcggtaaccctacccggttactccccgtactacccggccccgttaacccgaaacccgtaacccggggtccccttaacggttcccggttcccccgtttacccccgtcggaccccttacccccgtaccgttaacccgaacggtcccgacccgttaccccggg

SEQ ID NO: 42774 - DNA, 599 bp, Homo sapiens
  misc_feature: GYAE6OF01B1K8E.31.14.B03.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactggagtgggtgcatttanacaattgatggagaataaaaaatttgcagactcgtgaaggcgatcaccntctcagacgaccttccaacatacgctgtactctaccaaatcgaaactagtcggtanaactaggttagaaagaacgacggactaaactttattatgtacgacgtaaagtattcgttggttacgagtcaatacaagtggtaggtagtagggtcgacgtcgacgaccggtggggaccaaggggacctaacgtcggtaccaccgttctacccgcacgccctaccaaccgaacgggtcccagttcccggtcccttaccccccgtgacccctacccctccgtaccaaacgcgtcctacccgg

SEQ ID NO: 42775 - DNA, 541 bp, Homo sapiens
  misc_feature: GYAE6OF01BV7HM.31.14.B03.1.454.CMB.1.raw
  modified_base (357)..(357): a, c, t, g, unknown or other
  misc_feature (357)..(357): n is a, c, g, or t
  modified_base (471)..(471): a, c, t, g, unknown or other
  misc_feature (471)..(471): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaatttacgcagactccgtgaagggccgattcaccatctccagagacccttccaaccatacgctgtatctccaaatgaacatggtnacagttgaagacacggacaacttattattgtgacgaaagtatttcgttggttcgagcatcaatgtggatgggtgctcgacaccgtgggccagggacacgtggtcaccgtctccncacgcctccaccgacggccccagtccggtcttccccccgtggccctaccccttccaccagcgcctacccg

SEQ ID NO: 42776 - DNA, 711 bp, Homo sapiens
  misc_feature: GYAE6OF01C50PP.31.14.B03.1.454.CMB.1.raw
  modified_base (188)..(188): a, c, t, g, unknown or other
  misc_feature (188)..(188): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcactgggtccgcaggccccaggcaagggctggagtgggtggcatttatacaatttgatggagaattaaaaattttcgcagactccgtagaggccgattcaccatcctcagacgacccttcaaccatacgctgtatctaccaaatgaacatgggtanactagttgaacgtacacggtacaaactttatttattgtagacgtaaagtcgtttcgttggttaccgagtactattacgaagttgtagggtaattaggggtcggtaccgttacggaaccgtacccgttcggggggaaccctaacgggggaaccgtacgtcgggtacccaacccgggtttccctccgtaccgtaacggtaccccccttacccggaaacccgaaaccgggggtccccctaacggttttaccccggggttcccccttttacccccccccgggttggaccccccgttaacccccctttccccggtaaccccgtaaaacgggacccggtccccgttaaacccccgggg

SEQ ID NO: 42777 - DNA, 559 bp, Homo sapiens
  misc_feature: GYAE6OF01ETAQS.31.14.B03.1.454.CMB.1.raw
  modified_base (531)..(531): a, c, t, g, unknown or other
  misc_feature (531)..(531): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttcgacagactccgtgaaggccgattcaccatctccagacgacccttccaaccataacgctagtactctaccaaatgaacatggtgaacagttacgaagacacgggctaaacgttatttaattgtagcgaaagtattcgttggttcgagtacatcaaatggtggagtagggtgctgacaccgtgggccaagggacacgtggtccaccgtctacctcacgccctaccaccgacgggcccatccggtccttcccccnggcccaccctcctaccagacncgtaccg

SEQ ID NO: 42778 - DNA, 755 bp, Homo sapiens
  misc_feature: GYAE6OF01A2HUK.31.14.B03.1.454.CMB.1.raw
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtcccgccaggcccccaggccaaggggactgggagtgggtggctattttanacaattttgatggaagaataaaaatttcgcagactccgtagaaggccattcaccatctccagagacccttccaaccatacgctgtatctaccaaatgaacatggtagacagttgaagacacggactaacttattattgtagacgtaaagtatttcgttaggttcgagtctatacgaaagttcggttagggtaagttaggggtggtacccgttcggtaaccgtaacccgggtcggggggtaacccaaagggggtaaacccgtaaccggttacggggttacccaaccccggttccttaccccgttaccgaacgggtaccccctttacccccgaaacccgggtaaaacccgggggtcccccctaaaccggtttcccccgggggtttaccccccttttacccccccccgggttaccgggacccccttaacccccccccggttacccctttaaaccccccgggaaaacccggtacccggtaccccccgtaaacccccgggg

SEQ ID NO: 42779 - DNA, 607 bp, Homo sapiens
  misc_feature: GYAE6OF01B5P3S.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggcatttanacaatttgatggagataaaaatttcgcagactcgtgaaggcgattcacatctccagacgtacccttaccaaccataacgctgtactctaccaaatgaacatggtagactagttagaagacacggactaacttattattgtagacgtaaagtatttcggttagttcgagtcaatcaaagttgtaggtagtaggggtcgctacgacgaccgtggggacccaagggtaacacgttgggtacctacccgttctcccgtacaccggtcctacccgtaaccgaaccgggccctacgttcccggttcccttccccccgtgggaccctaccccgtccctacccaacggtcgtccctaacccgg

SEQ ID NO: 42780 - DNA, 575 bp, Homo sapiens
  misc_feature: GYAE6OF01B8G7J.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (463)..(463): a, c, t, g, unknown or other
  misc_feature (463)..(463): n is a, c, g, or t
tcagcagtagacgtcacgaccggtgctcgatttagtgtgagtagtttgggctgagcgtggtttccgtcgttaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaaggggactggagtgggtgcatttanacaatttgatggagaataaaaatttacgcagactccgtgaaggccgattcaccatctcagacgacccttccaaccatacgctagtatctaccaaatgaacatggtanacagttagaagacacggacaacttattatgtagacgaaagtnttcgttgttcgagctatcatgtggtatagggtgtctcgacgaccgtgggaccagggacncgtggtccaccgtctcctcacgtccctaccgaccgaacgggccctaagttccgggtcccttccccccgtggacccctaccccgtccctacccaacgccgccctaaccccggg

SEQ ID NO: 42781 - DNA, 798 bp, Homo sapiens
  misc_feature: GYAE6OF01ARS9L.31.14.B03.1.454.CMB.1.raw
  modified_base (213)..(213): a, c, t, g, unknown or other
  misc_feature (213)..(213): n is a, c, g, or t
  modified_base (357)..(357): a, c, t, g, unknown or other
  misc_feature (357)..(357): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttatacaatttgatggagataaaaattttcgcagactccgtgaaggccgattcaccatctccagacgacccttcaaccatacgctgtatctacaaatgaacatggtanacagttgaagacacggactaactttattattgtagacgaaagtatttcggttagggttaccgagacagttacctaaagttcgggttagggagttaacgggggtcggtaccgttaccggaaccgtaccccgggttaggggggaccccgtaaagggggggtaaaccctaccggttacgggggttacccctaaacccccgggtttccgttacccccggttacccgtaaacccgggtccccctttaaaccccccggaaaaccccccggtaaaacgggggggtaccccccccttaaaccggtttccccggggggttttaacccccccctttttccccccccccgggttacggggttacccccccgtaaacccccccccggttttaccccgttaacccccggaaaaacccgggttacccggaccccccgtttaaaaccccccggggg

SEQ ID NO: 42782 - DNA, 564 bp, Homo sapiens
  misc_feature: GYAE6OF01EKU0P.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagaataaaaaattttacgcagactccgtgaagggccgattcacatctccagagacccttcaaccatacgctgtatctccaaatgaacatggtgacagttgaagacacggcaacttattattgtgacgaaagtattcgttggtacgagcatcaatgtggatagggtgctcgacaccgtggggccaggggaacacgtggtaccaccgtctccctcgacgccctacccaccgtaacgggccccagttccggtcccttccccccgtggcccctacccctccctacccaacgcgccctacccg

SEQ ID NO: 42783 - DNA, 566 bp, Homo sapiens
  misc_feature: GYAE6OF01CH04R.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (470)..(470): a, c, t, g, unknown or other
  misc_feature (470)..(470): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanacatttgatggagataaaaatttcgnagactcgngaggcgattcacatctcagacgacccttcaaccatacgctgtatctacaaatgaacatggtagacagttagaagacacggactaaactttattattgtagacgtaaaagtcgtttacggtttggttacgagtactaatactaatggtaggagtagggtgctcgacaccgtggggaccagggaacncgtggtcaccgtctcctcgcgccctaccaccgaacggcccctagtcccggttccctcccccgtggccctaccctccctaccaacgcgcctacccgg

SEQ ID NO: 42784 - DNA, 577 bp, Homo sapiens
  misc_feature: GYAE6OF01D78GF.31.14.B03.1.454.CMB.1.raw
  modified_base (214)..(214): a, c, t, g, unknown or other
  misc_feature (214)..(214): n is a, c, g, or t
  modified_base (406)..(406): a, c, t, g, unknown or other
  misc_feature (406)..(406): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagaataaaaaattttacgcagactccgtgaaggccgattcaccatctccagacgacccttccaaccatacgctgtatctaccaaatgaacatggtagacagttagaacgacacggactaacttattattgtgacgaaagtnttcgttggttcgagcatcaatgtagatagggtgctcgacaccgtggggaccagggaacagtgccaccgtctcctcacgccctaccaccgaacgggcccctagttcccggttcccttccccccgtgggacccctacccccgttacccacccgaaacggcgcccgtaacccgg

SEQ ID NO: 42785 - DNA, 554 bp, Homo sapiens
  misc_feature: GYAE6OF01B78H2.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (483)..(483): a, c, t, g, unknown or other
  misc_feature (483)..(483): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactggagtgggtggcatttanacaatttgatggagataaaaaattttacgcagactccgtgaagggccgattcaccatctccagacgacccttccaaccatacgctgtatctaccaaatgaacatggtgacagttgaagacacggctaaacttattattgtagacgtaaagtatttcgttggttcgagcatcaatgtagagtagggtgctcgacaccgtgggccagggacacgtggtcaccgtctcctcncgccctccaccgaacgggccctagtcccggtccttcccccgtgcccacccttccacccaagcgcctacccg

SEQ ID NO: 42786 - DNA, 736 bp, Homo sapiens
  misc_feature: GYAE6OF01EFJGF.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccnccaggccccaggcaagggactggagtgggtgctatttanacaatttgataggagtaataaaaaatttcgcagactcgtagaaggccgattcaccatctccanacgacccttacaaccatacgctacgtatacctaccaaatcgaactagtgggtgaacgtagttacgaagacgaacggactaaactttagtttaattggtacggaacgtaaagttacgtttacggtttacgggtttacgaacggtacctaagttaccgtaaagttgggttaagggtaggttaagggggtcggtacctaccggaacgaacgggttcgggggaacctaacggggaacctaaccgttgggtaccctaacccggttccctcccgttaccgaacggtccccctaacccgaaccccggtaaccggggtcccccctaagggttccccggttcccccgtttacccccccgtacggggacccccttacccccgttccccgtttaaacccgaacggttacccgacccgttaacccccggg

SEQ ID NO: 42787 - DNA, 658 bp, Homo sapiens
  misc_feature: GYAE6OF01BA825.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgctatttanacaatttgatggaagtaataaaaaatttcgacagactcgtagaaggccgattcacatctccagacgacccttccaaccatacgctgtatcctaccaaatagaacagtggtagacgtagttagaagacacggactaaacttattattgtagacgtaagtagtttcgttaggttacgagtcaatactaatggtaggtagttaggggtcgacgtacgactaccggtggggaccaaggggaacctacgtcggtacctaccgtcctacctaccgacgtccctacccgaacccgaaccggggtccccctaacggttccccggttcccctttacccccccggtacggtaccccccgtaccccccgttacccccttaacccggaaacccggtaccgtccccgtaacccccgg

SEQ ID NO: 42788 - DNA, 721 bp, Homo sapiens
  misc_feature: GYAE6OF01C7QHT.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccacggccccaggcaagggactgggagtgggtggctatttatacaatttgataggaagaattaaaaaatttacgacagactccggtaggaaggccgattacacactctccagacgtacccttaccaacatacgctagtactacctacctaatacgaactagtggtagaactagtagaacgacgacggtactaactttattattcgtagacgtaaagtgtttaccggttaggttacgagtactaattacgtaagttcggtagggtaacggttaggggttacgaccgttaccggaaccgtacccgggtacgggggacccgtaaaggggaacccgtaaccggttcgggtacccgtacccgttaccgttcccgtaccgtaccgtccccgtaccccgaaccgtaacccggggtcccctaacgttccccggtttccccgtttacccccccgtcgggtacccccctaaccccgttcccctaacccggtaaccgccgtccccgtaaccccggg

SEQ ID NO: 42789 - DNA, 869 bp, Homo sapiens
  misc_feature: GYAE6OF01E56EU.31.14.B03.1.454.CMB.1.raw
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccgccaggccccaggcaaggggactgggagtgggtgctatttanactaatttgataggaataattaaaaatttcgacagactcggtaggaacgggccattccaccatcctaccaacgaccgtaaccccttaccaaacctataccgcttagtaactacctaaccaaagttacgaacctagtacggtagaacgtaaggttacgaaacgaacgtaaccgggtaacttaaactttaagtttaagtttaggtaacggtaacggtaaaacggttcgtttacggggtttacggttaccggaagtaaccttaacgttaacgtaaaacggtttgggttaaggggtaaacggttacggggttccgggtaacccgttacccgggtaacccggtaccccggggttacggggggaaccccggaaagggggtaaacccctaccgggtttacgggttaccccttaaccccgttcccttaccccgtacccgtaacccggtaccccttacccccggaaaaccccggaacccggggttccccccttaacgggtttcccccccgggtttccccccttacccccccggttacccgggtacccccccgttaacccccctttaccccccggaaacccggtaaacccgggtccccggtacccgttaccccccggggg

SEQ ID NO: 42790 - DNA, 728 bp, Homo sapiens
  misc_feature: GYAE6OF01B8LEQ.31.14.B03.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggcgtggagcgtgggttttcctcgttgactcttttaagaggtgtccagtgtcaggtgcacctggtggactcgtggggagcgtggtccggcctgggggtccctgagactctcctgtgccatgtctgcgtctagaattcactccgtcgaggcactagtcggacatgcctacggtcgggtcccnccgaacgggcccccagggcctaaagggcctgggagtgggtagctatttanactaatttgataggaagtaataaaaaatttcgacagtacctccgtagaacgggccattcacctatctacgagcgacccttcaactanacgntgtactctaccaaatcgaacagtggtagaactggtagaacgcgacgactaactttattactgtacgaacgtaatacgttccggttggttaccgagtacctaagttacctaaaggttggtagggtaacgttacgggggtcgttacccgttcggaacccgtaaccgggttcggggaaccccgtaaagggggtaacctaacccgggtttcgggtaacccgtaccgggttcctacccgttaccgggacctcccgtaacccgaccggtaaacccggtccgtaaccggttcccggtcccgtttaacccccgcgggtaccccttaccccgtacccggacctaacgggaaccctcccgtacccggg

SEQ ID NO: 42791 - DNA, 561 bp, Homo sapiens
  misc_feature: GYAE6OF01AUYH0.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaatttacgcagactccgtgaagggccgattcaccatctccagacgacccttccaaccatacgctgtatctaccaaatgaaacatggtagaactagttagaagacacggactaaacttattattgtagacgtaaagtatttcgttggttacgagtcatcaaatgtaggatagggtgctcgacaccgtggggaccagggacacgtcggtctaccgtctcctcacgcctaccgaccgaacggccctagtccggtccttcccccgngccctaccctcctaccaagcgctacccg

SEQ ID NO: 42792 - DNA, 610 bp, Homo sapiens
  misc_feature: GYAE6OF01CEUAV.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactggagtgggtgcatttanacaattgatgagaataaaaatttacgacagactcgtgaaggccgatcacatctcagacgacccttccaaccatacgctgtactctaccaaatgaaacagtggtagactagttagaagacacggactaaactttattagttgtagacgtaaagtagtttcggttaggttacgagcaatacaaagtgtagggaagtagggtgctacgacgaccgtcggggaccaagggaacacgtggtccaccgtctcctcgacgtccctacccgacccgaacgggtcccctaagttcccggttccctttacccccccgtggacccctacccccgttccctaaccccgaaacgccgccctaaccccggg

SEQ ID NO: 42793 - DNA, 679 bp, Homo sapiens
  misc_feature: GYAE6OF01B080C.31.14.B03.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcactatggcatgcacgtgggtccnccaggcccaggcaagggctggagtgggtgctatttanacatttgataggaagtaataaaaatttcgacagactccgtagaaggccgtattcaccatctacagacgacctccaacatacgctagatctacaatanaacagtggtnactagtagaagacacgtacaacttattatgtagtacgtaagtgttacgtaggttacagactatactaagttgtagggtaacgtagggtcgaccgtacgacgtaccggtacgggggaccaaggggaaactccggtaggtacctaacccggttcctacccgtacgaaccgtccccctaccgtaaaccccggtaaacgggggtccccctaagggttccccggttccccccgtttacccccccggtacgggaccccccttaaccccccgtttcccccgtaaacccggttaaacccggaccggtacccccgttaaacccccgg

SEQ ID NO: 42794 - DNA, 804 bp, Homo sapiens
  misc_feature: GYAE6OF01BQ3JR.31.14.B03.1.454.CMB.1.raw
tcagcagtagacgtcacgaccggtgctcgatttagtgtgagtagtttgggcgtgagccttgggttttcctcgttgctctttttaagaggtgtccagtgtcaggtgcacctggtggaatctgggggagcgtggtccggcctgggggtccctgagactcgtcctgtgccatgtctgcgtctgtaattcagtcctcgaggcctacgttatggcattgtcgacgtcgggtccgccgaggccccaggcaagggactgggaggtgggtgcgtatttagacgtaatttgagtggaagtaattaaaaatttcgactagactccgtgaacgggccgtattcacatctccagacgacccttcaacctatacgctagtactctaccaaatcgaacgtatcggtacgaacgtaggttacgaaaggaccgaacgggtactaaacgtttacgtttagtttaggtacgtaacgttaaaggtacgtttacggttaagggttacgaagtaccgtagttaccgtaaaggttggttagggtaacggttacggggtacggtccttacccggtaaccgtacccgggtttcgggggaacccgaacgggggtaaaccctaacccgggttacgggttacccgttaacccggttaccgttaccccgttcgtaacccgtccccttacccgaaacccggtaaccggggtccccctaaaccgggtttccccgggttaccccccttttaaccccccggccggggttaaccccctaaccccccggtttcccccgaaacccgaaaacccggttcccgtccccgttaaaccccggg

SEQ ID NO: 42795 - DNA, 566 bp, Homo sapiens
  misc_feature: GYAE6OF01B1Z80.31.14.B03.1.454.CMB.1.raw
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (488)..(488): a, c, t, g, unknown or other
  misc_feature (488)..(488): n is a, c, g, or t
  modified_base (532)..(532): a, c, t, g, unknown or other
  misc_feature (532)..(532): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccaggccccaggcaagggactggagtgggtgctatttatacaatttgatggagtaattaaaaatttcgacagactcgtagaaggccgattcaccatctccagacgacccttaccaacatacnctagtatctacaaatgaacntggtnacagttagaanacgacgactaacttattattgagacgaaagtatttcggttaggtcgagctaatcaagttggtaggagtagggtggctcgacaccggtgggacagggacacgtgtaccaccgtcnctcaccgaccccacgaaccggcccactccggttacccttccccnggcccacccctcctacaacgcnccnccgtccggg

SEQ ID NO: 42796 - DNA, 717 bp, Homo sapiens
  misc_feature: GYAE6OF01AGRJW.31.14.B03.1.454.CMB.1.raw
  modified_base (235)..(235): a, c, t, g, unknown or other
  misc_feature (235)..(235): n is a, c, g, or t
tcagcagtagacgtcacgaccggtgctcgatttagtgtgagtagtttcggttgggggagctacaacaggcaggcaggggcagcaagatggtgttgcagacccaggtcttcatttctctgttgctctggatctctggtgcctacggggacattcgtgatgacgacagttccagacctccctggctgtgtctctgggcgagagggccaccatcaactgcaacgtccagccagagttntttttactgccccaccaactaaactaacgtacttacgtacgttcgttacgtacgagacgaaagtaacgacgacgtacctaccgtaacctcgtctacttacgtcgggtaccttacgttaacccgggtcgtaccgttcccgggttacccggtaaaccggttaccggttacccgtacgttacggacgtacggtacgggtcggtacgggaaccggtcggttactacggaccgttacgaacctacgtactaccgaccacgtaccgtacggacgacggtaccgtacgaaggtacgtgggtaccgtacgtaaaggtttacgttacggtacgtactaagttacgtaacttagttaactaacgtttacttaacgttacttaactttaccgggaccgttacgtaaccgtagggtcggtaacgtaaccgtaaacggaacgtaaggttggaacgtaccaagtacccgtataccgtacgttcgtaaccctgtacc

SEQ ID NO: 42797 - DNA, 794 bp, Homo sapiens
  misc_feature: GYAE6OF01B7G4G.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccacggccccaggacgaagggactgggagtgggtgctattttatactaatttgataggaagaattaaaaaattttacgacaagactaccggtgaagggccgattcaccatctaccagacgaccctaccaaccatacgctgtactctaccaaatgaacagtaggtagaacagttagaacgacgacggactaaactttattaacgttaggtagtacggtaaaagttacgtttacggtttacgggttacgaagtactaataacgtaaagttgggttaggtaaggttaacggggtcgggtaccgttaccgggaaccgtacccgggttacgggggaccccgtaaacgggggtaaaccctaaccggttacggggtacccttaaccccgggttcccttaccccgttaacccgtaacccggtaccccccgttaacccccggaaaccccggtaaaacccgggggtccccctaaccgggtttcccccgggttacccccgtttaccccccccggtccgggtaacccccctaccccccgttacccccgttaaccccggaaaccggtcccggtccccgttaaaccccgggg

SEQ ID NO: 42798 - DNA, 558 bp, Homo sapiens
  misc_feature: GYAE6OF01BI919.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaaatttacgcagactccgtgaagggccgattcaccatctcagagacccttccaaccatacgctgtatctaccaaatgaacatggtgacagttgaagacacggactaacttattattgtagacgaaagtattcgttggttcgagactatcaatgtggatagggtgctcgacaccgtggggcccaggggaacacgtggtccaccgtctcctcacgccctcccaccgaacgggcccctagtccggtccttccccctggaccctacccctcctacccaagcgccgtacccg

SEQ ID NO: 42799 - DNA, 650 bp, Homo sapiens
  misc_feature: GYAE6OF01CV86O.31.14.B03.1.454.CMB.1.raw
  modified_base (218)..(218): a, c, t, g, unknown or other
  misc_feature (218)..(218): n is a, c, g, or t
  modified_base (617)..(617): a, c, t, g, unknown or other
  misc_feature (617)..(617): n is a, c, g, or t
  modified_base (631)..(631): a, c, t, g, unknown or other
  misc_feature (631)..(631): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccnccagggccccaggccaagggactgggagtgggtgctatttatactaatttgataggaagtaaattaaaaaatttcgacaagtactaccggtaggaacgggccgtattccaacctatcctaccaacgaccgtaacccttaccaaacctatacgctacgtactacctacaaatgaaactagtggacaactaggtagaacgacgacgtactaaactttattatgtagaacgtaaagtcgtttcggttaggttacgagtactaatacgaagttggtaggaagtaggggtcgcgtacgaacgtaccggtgggggacccaaggggaacctgtacgggttccacccggttctccacgacgacccctaccgacgtaacgggccctagttcccggtcccttcccccgnggccctaccccctnacccgaagccgcctaccgg

SEQ ID NO: 42800 - DNA, 572 bp, Homo sapiens
  misc_feature: GYAE6OF01BIOC2.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanacatttgatggagataaaaaattttacgcagactccatgaaggccgattcaccatctccagacgacccttccaaccatacgctgtatctccaaatgaacatggngacagttgaagacacggcaaacttattattgtgacgtaaagtatttcgttgggttacgagtcaatacaattggtggagtagggtggctcgaacacgtggggaccaaggggaacacgtgggtccaccggtctccctcacgccctaccgaccgaacgggccccaagtcccggtccttccccccgtcggccctacccctccctacccaaagccgtacccg

SEQ ID NO: 42801 - DNA, 785 bp, Homo sapiens
  misc_feature: GYAE6OF01D1UMS.31.14.B03.1.454.CMB.1.raw
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgcacgtcgggtccgccacggccccaggcgaagggctgggagtggtgctatttanatatttgagtaggaagtaaattaaaaaagtttcgactaacgtaccgtaccggtaggaacgggccgtaacttccaacctatcctaccagaaccgtacccttaccaactacgtacgtctagtactacctaacaaagtacgaacgtagtggtacgaagtagttaacggaacgaacgtaacggaacttaaacttagtttagtaggttacgtaacggtaaaagttcgtttacgggttacggttaacgtagtacctaagttacgtaaagttcgggttaggtaaggttaggggtcgtaccgtaccgggtaacgtacccgggagggggtaacccgaaggggtaacccaacgggtttccggtaccccgtcccgttaccgtacccgtacgtacccggttacccaccccggtaaacccggtacccgggtaccccgtaacggttcccccgggtttacccgtttaccccccccggtacgggtacccccttaacccccgttacccaaccccggaaacggtccccgaaccccgttaccccggg

SEQ ID NO: 42802 - DNA, 827 bp, Homo sapiens
  misc_feature: GYAE6OF01CORGH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactagtggcatgcacgtgggtcccgccacggccccaggcgaaaggggactgggaggtgggtggactaattttataactaatttgaataggaagtaaaattaaaaaaattttacgacaagactaccggtaggaacggccgtaattccaacctatcctaccagaccgtaacccttaccaaacctatacgctagtactactaaccaaatacgaaacagtggtacgaactagttaagaaacgaaccgacggtaactaaacgtttaatttagttaggtacgaacgtaaaggttacgtttcgggtttaggttacgagtacctaagttaaccaaaggttgggttaagggtaaggtttaagggggtcgtacccggtaaccggtaaccgtaacccggggttacgggggaacccgaaacgggggtaaccctaaccgggtttaccgggtaacccctaccccggttaccctacccgttcccaaccgggtcccccctaaaccccgaaaccccgggttaaaccgggcccccttaacggtttccccccgggtttcccccgtttcccccccgggtacccggtaccccctaaccccccccggttacccttaaaccccgaaaaccgggtcccgtaaccccgtaaccccgggg

SEQ ID NO: 42803 - DNA, 650 bp, Homo sapiens
  misc_feature: GYAE6OF01BQ33C.31.14.B03.1.454.CMB.1.raw
  modified_base (545)..(545): a, c, t, g, unknown or other
  misc_feature (545)..(545): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggaggtgggtggctatttataactaatttgagtggaagtaattaaaaaattttcgacagtacctccggtaggaacgggccgtattccaccatcctaccagacgtaccctaccaaccatacgctagtactctaccaaatagaactagtaggtagactagttagaagacacggactaacttattagttgtagacgtaagtacgtttcggttaggttacgagtctaatactaagttggtaggtagtaggggtcgcgtacgaccgccggtggggaccgaagggaacctacgtcggtacctacccgtcctaccncgaccgtccctacccgaacccggaccggcccctacgttccccggttcccttcccccgtcggacccctaccccctacccgtaaccaacggccgtcccgtacccggg

SEQ ID NO: 42804 - DNA, 581 bp, Homo sapiens
  misc_feature: GYAE6OF01CUVIM.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggctatttanacaatttgatggaagtataaaaaattttacgcagactccgtagaagggccgattcaccatctccagacgacccttccaaccatacgctgtatctccaaatgaacatggtagacagttagaagacacggactaaactttattattgtgtacgtaaagtatttcgttggtacgagcaatcaagtgtaggagtagggtgcctggacacgtggggaccaggggaacacgtggtccaccgtctcctcagccctaccgaccaacgggccctacgtccggttcccttcccccgtggaccctacccctccctaccaaacgccgcgtaaccccgg

SEQ ID NO: 42805 - DNA, 582 bp, Homo sapiens
  misc_feature: GYAE6OF01AIYQN.31.14.B03.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggctggagtgggtggcatttatacaatttgatggagataaaaatttacgcagactccgtgaagggccattcaccatctccagagacccttcaaccatacgctgtatctccaaatgaacatggtnacagttgaagacacggcaaacttattattgtagcgaaagattcgtggttcgagtcatcaatgtaggatagggtgctcgacaccgtggggccaagggaacacgtggtccaccggtctccctcgacgccctaccaacccgaacggggcccccaagttcccgggtccctttccccccccgtagggcccctaacccccgttcccttaccccgaaacgtccggccctaaccccgg

SEQ ID NO: 42806 - DNA, 746 bp, Homo sapiens
  misc_feature: GYAE6OF01B61BG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggacgtggggggtccctgagactctcctgtgccatgtctgcgtctgaattcatccctcaggcactatggcatgcacgtcggggtcccgccgaacggcccccagggccaagggggactggggaggtgggtggctatttatacaattttgataggaagtaaattaaaaaatttacgacaagtacctccggtaggaagggccgaattcaccatcctccaagacgacccttaccaaccataccgctagtactcctacaaatgaacagtggtagaactagttagaacgacgacggtactaaactttattagttagtacggtacggtaaagttagtttccgggttagggtttacgaagtacctaagtacgtaaaggttggttagggaagttaggggtcggtaccttacggaccgtaccgggttcgggggaaccctaaggggaacctacggttccgggtaccctacccgttcttacccctacgaccgtacccctacccgaaccggaaaccggggtccccctaaggtttccccgggttccccctttacccccccggtcgggtaccccctacccccccttacccgtaaccccgaaacggtacccggccccgttaaccccggg

SEQ ID NO: 42807 - DNA, 599 bp, Homo sapiens
  misc_feature: GYAE6OF01CJ1E1.31.14.B03.1.454.CMB.1.raw
  modified_base (253)..(253): a, c, t, g, unknown or other
  misc_feature (253)..(253): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagaataaaaatttcgcagactccgtagaaggcgattcaccatctccagacgacccttccaacatacgctgtactactacaaatcgaaacagtggtgaactagttagaacgacacggactaacttattagttgtagtacgaaagtnttcggtttggttacgatctatacaagtgtaggagtagggtgactcgacaccgtggggaccaagggactacgtcggtacacccgtctccgcacgtccctaccgacgaacggcccctagttcccgggtcccttccccccgtggtaccccacccctttacccgaccctaaacggccgtcccgtaaccccggg

SEQ ID NO: 42808 - DNA, 608 bp, Homo sapiens
  misc_feature: GYAE6OF01D1YRI.31.14.B03.1.454.CMB.1.raw
  modified_base (214)..(214): a, c, t, g, unknown or other
  misc_feature (214)..(214): n is a, c, g, or t
  modified_base (284)..(284): a, c, t, g, unknown or other
  misc_feature (284)..(284): n is a, c, g, or t
  modified_base (408)..(408): a, c, t, g, unknown or other
  misc_feature (408)..(408): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttatacaattttgatggagaataaaaaattttacgnagactccgtgaaggccgattcaccatctccagacgacccttccaaccatacgctgtatctacaaatgaacatggtgacagttgaacgacacggactaaactttattattgtagacgtaaaagtntttcggttggttacgaagctaataccaaagttgtagggtataggggttcgcctacggactaccgtggggacccaaggggaaccacgttcggtccaaccgttcctccctacgacgtcccctcccgaaccaacgggcccctagttcccggttcccttccccccgtggacccctacccctcctacccaacgcgccctacccgg

SEQ ID NO: 42809 - DNA, 766 bp, Homo sapiens
  misc_feature: GYAE6OF01EGPZ1.31.14.B03.1.454.CMB.1.raw
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
tcagcagtagacgtcacgaccggtgctcgatttagtgtgagtagtttgggctgagctgggttttcctcgttgctctttttaaagaggtgtccagtgtcaggtgcacctggtggaatcgtgggggaggcgtggtccggcgtgggggtccctgagactctcctgtgccatgtctgcgtctagaattcatcctcaggcactagtggcagtgctacgtcgggtcccnccgacggccccagggacgaagggactgggaggtgggtgcttatttanactaagtttgagtaggaagtaaattaaaaaagttttacgacagtaccttcggtaggaacgggccgtattccaccattcctaccgagaccgtaccccttaccaaacctactaccgtacttagttaactacctaaccaaagtacgaaacctagttgggtagaacgtaggttaagaacgacgaacggacttaaactttatttagttaggtagaacggtaaagttacgtttcggtttaggttacgagtactaatacgtaagttgggttaggtaggttaggggtcggtccgttaccggaaccgtaccgggtacgggggaaccgtaaggggtaaccctacggttccgggtaccctaacccggttccttacccgtacgacccgtcccctaacccgaacccggtaaaccgggtcccctaacggttcccgggttcccccttacccccggtcggtaccccctaacccccttcccgaacccgaaacggtccgtacccggtaccccgg

SEQ ID NO: 42810 - DNA, 807 bp, Homo sapiens
  misc_feature: GYAE6OF01D2B9S.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctggagactctcctgtcgcctatgtctgcgttctagtacttcactcctcgaggacctacttagtcggactagtcgacctacggttccggggtcccgaccgaccggcccccgaagggacgaacggggtacgtgggtagggttggggtcgacttaattttaactaacttaaagttttgagtagggaaagttaaaaatttaaaaaacttttcgacaacgtaccgtccggtaaggaacgggtcctattaccacctatcctaccgagaccgtaccccttaccaactactaccgtctgtactcctaacaaagtacaactagtggtacgactagttaacgaacgacgtacggaacttaactttattagttaggtacggtaacgtaaagtttcgtttacgggtttacggtacgagtactaactacgtaagttgggtaggtaaggttcggggtcgtccgtaccggaacgtacccggggtcgggaaccgaacgggtaacctacggttcggtacccgtacccgttcctaccgtaccgaccgtcccgtacccgaaccgggtaacccgggccccttagggttcccccggtttaccccttcccccccgggtacggaccccccttaacccccgtacccgtaacccggaaaccgggtccgtaccccgttaccccggg

SEQ ID NO: 42811 - DNA, 745 bp, Homo sapiens
  misc_feature: GYAE6OF01A92HQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcagtgcacgtgggtccgccgaggccccaggcaagggctggagtgggtggctatttatacaatttgatggagaataaaaatttcgcagactcgtagaaggccgattcaccgatctcagacgacccttcaaccatacgctgtactctaccaaatcgaactatggtgacagttagaacgacaacggctaaacttattaagttgtagacgtaaagtagtttcggttaggttccgaaggtactaagttactaaagttcggtagggtaacgttaaggggggttcggaccgtttacccgggaacccgtaaccccgggttacgggggggaacccgtaaacggggggtaaaccctaccgggtttacggggttacccctaaccccgggtttccctaccccgttccgaccggtaccccttaccccggaaacccgtaaacgggggcccccttaaaccggttccccgggttaccccttttccccccccgtaggggtaccccctacccccggtttaccccctaaccccgaaaccggacccggtcccgtaaacccccgggg

SEQ ID NO: 42812 - DNA, 601 bp, Homo sapiens
  misc_feature: GYAE6OF01CGI6H.31.14.B03.1.454.CMB.1.raw
  modified_base (215)..(215): a, c, t, g, unknown or other
  misc_feature (215)..(215): n is a, c, g, or t
  modified_base (348)..(348): a, c, t, g, unknown or other
  misc_feature (348)..(348): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccaggcaagggactggagtgggtgctatttatacaatttgataggaagtaaattaaaaaatttacgcagactccgtagaacggccgtattcaccatctccagacgacccttacaaccatacgctntactactaccaaaatgaaacatggtgaactagttagaagacacggactaaactttaattagttcgtagacgtaaaagtagtttcggttaggttacgagtacatacgaatggtagagtagggtgctacgactacgtgggaccagggaacncgtagtaccaccgtctccncacgcctaccgaaccaacgggccctaagtccggttccctacccccgngacccgtacccctacctaccaaacgtcgctaaccccgg

SEQ ID NO: 42813 - DNA, 649 bp, Homo sapiens
  misc_feature: GYAE6OF01BWH0F.31.14.B03.1.454.CMB.1.raw
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
tcagcagtagacgtcacgaccggtgctcgatttagtgtgagtagtttgggctgagcgtggttttcgtcgttagctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggccncacggcccaggcaagggctggagtgggtgctatttatacaatttgagtgaagtaattaaaaatttcgacagtactcgtgaaggcgtnttacacatctcagacacctacaaccatacgctagtactcctacaaatcgaacagtgtaggactaagtacgaagacgacggtactaaacgtttattagttcgtagtaaggtaagttagtttcgggttcggttacgaggtacaagtactaaagtgggttaggagttaaggggtcgcgttacggaacaccgggttacgggaccgtaacggggaactacgttacgggtaccctaccggttctcccgtacgaccgtacccgtacccgaacccggacggtccctaacggttcccggttcccctacccgtcggaccctacccctccgtacgaacgtcccgtcgtaacccggg

SEQ ID NO: 42814 - DNA, 610 bp, Homo sapiens
  misc_feature: GYAE6OF01CCOMK.31.14.B03.1.454.CMB.1.raw
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggactgggagtgggtggcatttatacaatttgatggagaataaaaaattttacgcagactccgtgaagggccgattcaccatctccagacgacccttccaaccataacgctgtatctacaaatgaacatggtanacagttgaagacacggactaactttattattgtgacgtaaagtatttcggttaggttcgagtacgatacaagtgtaggaagtagggtgctcgacaccgtggggaccaagggaaccacgtcggtaccaccgttcctcctaccgacgtccctaccgaaccgaaacgggcccctaagttcccggttcccttcccccccgtgggacccctaccccttcccctacccgtaaacgaccgccctaaccccgg

SEQ ID NO: 42815 - DNA, 689 bp, Homo sapiens
  misc_feature: GYAE6OF01BAT5T.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccacggcccccagggcaagggactgggagtgggtggctatttatactaatttggatggaagtaattaaaaaacttttacgactaagaccttacccggtaggaacggggcccgtaagtttccaacctacttcctacccgaaggaaccgtacccctttacccaaaacctactaaccgtctagttaacttcctaccaaaatcgaaactagtggtagaacgtaggttacgaaagacgaacggtactaaactttagttattggtacgacgtaaagtatttacggtttggtacgagctaatacaagttgtaggtataggggtcgcgttacgaaccgtaccggtggggaccaaggggtaaccacgttcggtaccacccgttctcctcgcgtaccctccgaacccgaacgggccctagtcccggttacccttccccccgtaggcccctaccccttacccgacccaacgccgtcccgtacccgg

SEQ ID NO: 42816 - DNA, 662 bp, Homo sapiens
  misc_feature: GYAE6OF01D4UKA.31.14.B03.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtcccggcctggggggtccctgagactctcctgtgccatgtctgcgtctgaattcatcctcaggcactatggcatgcacgtgggtcccncaggccccaggcaagggactgggagtgggtgcattttanactaatttgatggaagaattaaaaaattttcgcaagactccgtgaacgggccgattcaccatctccagacgacccttccaaccatacgctgtactcccaatagaacatgtgacagtgaagacgacgtacgaacttattacttagtgtacgaagtaagtttcgtttgggttacgtacgtacgtaactacgtaagttgtacgggtaagtagggttacggcttaccggtacgacccgtacggggccgaacgggaaccgacgtacgggtacctacccggttaccttacctccgaccgtcccgtaccgaccccgaaacgggtacccccgtacgttcccggttcccccgtttacccctcccggtacccaccccttccccaccgtaaccgccgtaccgtacccgtacccgggg

SEQ ID NO: 42817 - DNA, 538 bp, Homo sapiens
  misc_feature: GYAE6OF01CH5GX.31.14.B03.1.454.CMB.1.raw
  modified_base (213)..(213): a, c, t, g, unknown or other
  misc_feature (213)..(213): n is a, c, g, or t
  modified_base (472)..(472): a, c, t, g, unknown or other
  misc_feature (472)..(472): n is a, c, g, or t
  modified_base (530)..(530): a, c, t, g, unknown or other
  misc_feature (530)..(530): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccnccaggcccccaggcaagggactggagtgggtggcatttatacaatttgatggagataaaaattttacgcagactccgtgaagggccgattcaccatctccagagacccttccaaccatacgctgtatctaccaaatgaacatggtagacagttgaagacacggacaacttattatgtgacgtaaagatttcgttaggttcgagcatcaatgtgatagggtgctcgacaccgtgggccggagacgtcgtcgactctctcncgcctccaccacggacccgactcggtcttccccgtcgtcaccctccctccaacacgcnccgtccgg

SEQ ID NO: 42818 - DNA, 565 bp, Homo sapiens
  misc_feature: GYAE6OF01EBZI1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcattttatacaatttgatggaagaattaaaaaattttacgacagactccgtgaagggccattcaccatctccagacgacccttccaaccatacgctgtactctaccaaatgaacatggtgacagttagaagacacggactaaacttattattgtagacgaaagtatttcggttggttcgagcatcaatgtaggatagggtgctcgacaccgtgggccagggacacgtggtaccaccgtctcctcacgcctccaccgaacgggccctagtcccggtccttcccccgtggcccctacccctccacccaagcgccgtacccg

SEQ ID NO: 42819 - DNA, 692 bp, Homo sapiens
  misc_feature: GYAE6OF01ALTZ0.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggactgggagtgggtggctatttanactaatttgatggagataaaaattttacgcagactccgtagaaggggccattcaccatcctccagacgacccttaccaaccatacgctagtactctaccaaatacgaacagtggtacgaactagttagaagaacgacgggactaaactttattagttaggtagacggtaaagtagtttacggtttgggttacgacgtctaatactaagtgggtaggagttaggggtgccgttacggaccaccggtcgggggaccgaacggggacctacggttcggtaccgtaccgttcctcccgtccgacggtcccctacccgacccggtaaccgggccccctagttaccccgggttccccgtttacccccccggtccgggtacccccgtaacccccgttcccccgttaaaccccggaacggtaacccggtcccgtacccccgggg

SEQ ID NO: 42820 - DNA, 767 bp, Homo sapiens
  misc_feature: GYAE6OF01DP7AT.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccacgggccccagggccaaagggactgggaggtgggtggctatttatactaatttgagtaggaagtaaattaaaaaaattttacgactagtaacctccggtaggaacgggcctaattcaacctatcctaccagaccgtaccccttaccaaaccataccgctagtactacctaccaaaagtcgaaacgtatacgggtagaacgtaagttaagaaacgacgaaccggtactaaaacgttttattaagttaggtagaacgtaaagtacgttttcggttaggttacgagtactaatacgtaagttggtaggtagttaggggtggtccgttacgacggtacccggtggggaacccgtaaggggtaaccctacggttcggtaccctaccccggttaccttcccgtaccgacccgttaccccgtaccccgaaacccgggaaccggggtaccccctaccggttaccccggggtttccccctttacccccccggtacggaacccccgttacccccccttaccgtaaccccgaaaacgggcccgtaccccgtaccccggg

SEQ ID NO: 42821 - DNA, 769 bp, Homo sapiens
  misc_feature: GYAE6OF01APYYQ.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagcgtggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaaattttacgacagactccgtgaagggccattcaccatctcagacgacccttccaaccatacgctagtactctaccaaatcgaacagtggtagacgtagttagaagaccaacggtactaaactttatttaacgttgtacgacgtaaacggttagtttcggttagggtttcgaagtactaacttacgtaaagttgggttggggtaaagttacgggggtaggtaccgttaccggaacccgtaccgggttacggggggaccccgaagggggtaaaccctacgggttaccggggttaccctaaccccggttaccgttaccccgtaccgtaaccggtcccccgttaaaccccgaaccccgggtaaaccggggtcccccctaagggtttaccccggggtttcccccttttacccccccccggtacggggtacccccccttaaaccccccgtttacccccgtaaccccgtaaaccggtcccgtaaccccggttaacccccgg

SEQ ID NO: 42822 - DNA, 591 bp, Homo sapiens
  misc_feature: GYAE6OF01EEKFE.31.14.B03.1.454.CMB.1.raw
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtcccgtgagactctcctgtgccatgtctgcgtctgaattcatcctcaggcactatggcatgcactgggtccgccaggcccccagggaccaaggggactgggagtgggtggcatttatacaatttgatggaagtataaaaaattttacgactagactaccggtgaagggtccgattcaccatcctccagacgaccccttccaaccatacgctgtatctaccaaatgaacatggtagacagtagaagacacgacaacttattattngntagacgtaagtagttcgttaggttacgtagtcaatctaatagtggtagtagggtggcgtacgtacgacctacgggaccgacggaacgactacggtacgaccgtcgtcctccacgccgtccgacccaacggcccgtactacccgtccgttccccctaccggtcccacccctcccgtccgaacg

SEQ ID NO: 42823 - DNA, 564 bp, Homo sapiens
  misc_feature: GYAE6OF01D47PE.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctaccaaatgaacatggtgacagttagaagacacggctaaacttattattgtagacgaaagtattcgttggttcgagcatcaatgtaggatagggtgctcgacaccgtggggccaagggacacgtggtcaccgtctcctcacgccctccaaccgaacgggcccctaagtccgggtccttccccccgtggcccctacccctcctacccaagcgcccgtaacccg

SEQ ID NO: 42824 - DNA, 623 bp, Homo sapiens
  misc_feature: GYAE6OF01EG2EQ.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagaataaaaaattttacgcagactccgtgaagggccgattcaccatctccagacgacccttccaaccatacgctgtactctaccaaatgaacatggtagacagttagaagacacggactaacgttatttattgtagacgaaagtatttcgttggttacgagactaatacaaagttggtaggtaataggggtggcgtacgaccgaccgtgggggaccaaggggaaccacggttacgggttaccacccggttcctccctccgacgtcccctaccaacccgtaacgggcccctagttcccggttcccttaccccccgtggacccctaccccctccctacccaacgtccgccgtaccccgg

SEQ ID NO: 42825 - DNA, 679 bp, Homo sapiens
  misc_feature: GYAE6OF01D5ZJY.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccaggccccaggcaagggactggagtgggtgctatttanactaatttgatggaataattaaaaaatttcgacagactccgtagaacggcgattcaccatctccagacgacccttccaacatacgctgtactctaccaaatacgaactagtggtagactagttagaagaacacggtactaaactttattattaggtagaacgtaaagttacgtttcggttaggttacgagtactaatacgtaaagttgggtaggtagttagggtcggtaccgtacggaaccgtaccggtgggggacccgaagggtaaccacggtcggtacctaccgttcctcctaccgaccgtccctacccgaaccggtaaccggggtcccctaacggttcccggttccccgttacccccccgtggacccccctaacccccgttaccctaacccggaaacggtcccggtcccgtaaccccggg

SEQ ID NO: 42826 - DNA, 733 bp, Homo sapiens
  misc_feature: GYAE6OF01C5NJZ.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggaagaataaaaaatttacgacagactcgtagaaggccgattcaccatctcagacgacccttaccaaccatacgctgtactctacaaatgaacatgtacgactagttagaagacacggtactaacttatttagtgtagacgtaaagtgtttacggttggttacgagtctaatactaaagttggttaggtaagttaggggtcgtccgttacggaacgtacccggttgggggaccctaagggggaaaccctacggttacgggtaccctaaccccggttccgttaccccgtaccgtaaccgtacccccgttaccccgaaaccccggtaaacccgggggtcccccctaaacgggtttcccccgggttaccccccgttttacccccccccggtacggggtacccccccttaacccccccgttacccccgttaacccccgaaaccgggtacccggtcccccgttaaacccccggg

SEQ ID NO: 42827 - DNA, 864 bp, Homo sapiens
  misc_feature: GYAE6OF01B1PG1.31.14.B03.1.454.CMB.1.raw
  modified_base (347)..(347): a, c, t, g, unknown or other
  misc_feature (347)..(347): n is a, c, g, or t
tcagcagtagacgtcacgaccggtgctcgatttagtgtgagtagtttagggtttgggggaggcctaacaacacggcaggcagggccagcaagatggtgttgcagacccaggtcttcgatttcgtctgttgcttctggatctctggtgcctacggggacatcgtgactggagccagtttccagacctcccgtggcgtggtgtcgtcgtagggacgagacggggccaccatcaaactgcaagtccaagcctagtagttgttttacttcggccccacaatacaactacttagcttggtaccagacaagaacgtaggacaggcctacctaaacgtccgtagtactttacgngggtcctttccgaccccggggtctacgttacccggggttacctaaaccggtactttccgaacgtttggaccgtacggtcccggggtacgtacggggtaacccgtacgttttaccgaccgttccgtaccctaaccccgtaagttacccgaacggtacccaaaccggtccccgttacggaaccgtaacgggtacccgttaacggaaaacggttacgttacgggttaccgggtaaccgttaacgggttttttaacttaacggttcgttacccggtaacgtaccggtaaaccttaagtttaacgtttaacccgtttcgttttaacccggttaccgttaacccggttttccggggaaccggggttaaccggggtaaccgttaacggggttacgggtaaaccgtaacggttaacccgtaaaaaccgggtaaccgtttaccgggtacgggttaccgttaaccggttacccgttaacccgttagtttacccggtttacgttaccggtttacccgtttaaacccgg

SEQ ID NO: 42828 - DNA, 826 bp, Homo sapiens
  misc_feature: GYAE6OF01EAL7Z.31.14.B03.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagcgtgggttttcctcgttgctcttttaagaggtgtccagtgtcaggtgcacctggtggaatcgtgggggagcgtggtccggctggggggtcctgagactctcctgtgccatgtctgcgtctgaattcatcctcaggcactatggcatggcncgtgggtccncacggccccaggcaaggggctggaggtgggtgctatttanactaatttgataggaagtaataaaaactttcgacagactcggtaggaacgggccgattacacctatcctaccgagtacgtaccctttacccaaaccgtacgttaccgacttacgtaacttaccgtaacccaaaagttcgaaaccgtagttacgggtacgtaccgtaaggtttaacggaaacggtaaccgtaacggtacctaaacttttacgttaagtttacggtaggtaacggtaaagttacgtttacgggttacggttacggtaacgtacctaattacccgtaaagttcggggttaagggtaagttacgggggttacgggtacgttaccgggaaccggtaccgggttacgggggaacccggtaacgggtaaacccgtaccgggttacgggttacccgttaacccgggttccttacccgttaacgaccggtacccccttacccgaaacccgggtaaacccgggtccctaacccggttcccgggtttaccccgttccccccggtacgggtacccccttaaccccccgttaccgtacccgaaacccggtcccggtaccccgttaaccccgggg

SEQ ID NO: 42829 - DNA, 600 bp, Homo sapiens
  misc_feature: GYAE6OF01AYBUN.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccagggcaagggactggagtgggtggcatttatacaatttgatggagataaaaatttcgcagactccgtgaagggccgattcaccatctccagacgaccctccaaccatacgctgtatctacaaatgaacatggtgacagttgaagacacggactaacttattattgtagacgaaagtatttcggttggttcgagacatacaatgtaggagtagggtgctacgacacccgtggggcccaaggggaacctacgtcggtaccacccgttctccctccacggtccctacccgaaccgaacgggtcccctagtccccgggttccccttaccccccgtcgggcccctaacccccttcccgtaacccgaacgcgccctaccccgg

SEQ ID NO: 42830 - DNA, 552 bp, Homo sapiens
  misc_feature: GYAE6OF01E41C9.31.14.B03.1.454.CMB.1.raw
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaaatttacgcagactccgtgaagggccgattcaccatctccagacgacccttccaaccatacgctgtatctaccaaatgaacatggtgacagttagaagacacggacaaacttattattgtagacgaaagtatttcggttggttcgagtcatcaatggtaggagtagggtgctcgacnccgtgggccaagggacacgtggtcaccgtctccncagcctccaaccgacgggcccagtccggtccttccccgngccctaccctccaccaacgcgctacccg

SEQ ID NO: 42831 - DNA, 577 bp, Homo sapiens
  misc_feature: GYAE6OF01BQ7OH.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgctatttanacaatttgatggagaattaaaaatttcgacagactccgtgagggccattcacatctccagacgacccttaccaaccatacgctgtactctaccaaatgaactatggtagactagttagaagacacggactaaactttattagttgtagacgtaaagtacgtttcggttggttacgagtactatacaagtgtggagtagggtgctacgacaccgtggggccaagggaacacgtggtccaccgtctcctcgacgtccctaccgaccgaacggccctacgtccggtcccttccccgcggccctacccctccaccacgcgccctaccgg

SEQ ID NO: 42832 - DNA, 740 bp, Homo sapiens
  misc_feature: GYAE6OF01ENCYZ.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactggagtgggtgcattttanacaatttgataggaagtaattaaaaaattttacgacagactccgtagaagggccgattcaccatctaccagacgacccttccaaccatacgctgtatctaccaaatgaacagtggtagactagttagaagacacggactaaactttattattagtagacgtaaagtagtttcggttggttacgagtacaattacgaaagttggtagggtagttaggggtcggtacctccggaaccgtacccgggtacggggggacccgaacgggggtaaaccctaccgggttacgggttacccgtaaccccggttacccgttacccgttacccgaccggtaccccttacccccgaaaccccggaaacccgggggtccccctaacggttccccggggttcccccttttccccccccggtaggggttaccccccctaacccccccgtttacccccgtaacccgtaaaacccgggtacccggaccccctaaccccggg

SEQ ID NO: 42833 - DNA, 739 bp, Homo sapiens
  misc_feature: GYAE6OF01A3D9L.31.14.B03.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctgggggagcgtggtccggcctggggggtccctgagactctcctgtgccatgtctgcgtctgaattcatcctcaggcactagtggcatgcacgtggggtccgccaacggcccccagggcaagggggtactgggagtgggtggctattttatacaatttgagtggaagtaattaaaaaattttacggacaagaacgtccggtagaacgggccgtaattcaccatctccagacgtacccttaccaaccatacgcctntactctaccaaatcgaactatggtagacgtagttagaacgacacggtactaaactttagttagttgtacgacgtaaagtcgtttacggttaggttacgagtcctaatacgtaaagttgggtaggtaaggttacggggtggtaccgtaccggtacgtaacccgggtcggggaaccgaacgggtaaacgtacggttcggtacccgtacccgttccgttacccgttaccgccgtacccccgtacccgaacccccgggtaaacggggtcccccctacggttaccccgggtttccccctttacccccccggtacggtacccccttaacccccggttacccttaaccccgaacggtacccgacccgtaaccccggg

SEQ ID NO: 42834 - DNA, 639 bp, Homo sapiens
  misc_feature: GYAE6OF01AHTJR.31.14.B03.1.454.CMB.1.raw
tcagcagtagacgtcacgaccggtgctcgatttagtgtgagtagtttgggctgggagctgggttttccgtcgttagctcttttaagaggtgtccacgtgtcaggtcgcacctggtggaatcctcgggggagcatggtccggccgtggggggtccctggaggactctcctggtgccatgtctgcgtctgaattcatcctcaggcactatggcatgcactgggtcccgccaggcccccaggcaagggactggagtgggtggcatttatacaatttgatggagaataaaaatttcgcagactccgtgaagggccgtatcaccatcctccagacgacccttaccaaccatacgctgtatctaccaaatgaaactatggtagactagttagaaacgacacggactaaactttattacgttggtgaacggaaagtagttccggtttgggtcgagctaatactaagtggtaggtagtaggggtggactcggaccgtaccggtcggggaccgaagggaacctacgtcggtaccacccgtactcccgtcaccgccccgtacccaaccgaacgggcccctaacggttcccggttaccccttccccccgtcggcccctaaccccctacccaccgaaacgtccgtaacccg

SEQ ID NO: 42835 - DNA, 667 bp, Homo sapiens
  misc_feature: GYAE6OF01AUYNZ.31.14.B03.1.454.CMB.1.raw
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactcgggtccgccaggcccccaggcaagggactgggaggtgggtggctatttanactaatttgatggaagtaataaaaaattttcgacagactccgtagaacgggccgattcaccatctccagacgacccttacaaccatacgctgtactctacaatgaacatggtanatagtagaacgacacggactaacttattatgtagacgtaaagtatttcggttaggtacgagctaattactaagtgtaggaagttaggggtcgtacgtacggaaccgtacccggtgggggaccaaggggtaaccacgtcggtacctacccggtcctacccgtacgaccgtccctacccgaacccggtaaccggggtcccctaacggttccccgggttccccttaccccccggtacggacccccctaacccccgttaccccgtaacccgaaacggtaccccgtcccgtaaccccggg

SEQ ID NO: 42836 - DNA, 549 bp, Homo sapiens
  misc_feature: GYAE6OF01DNKQV.31.14.B03.1.454.CMB.1.raw
  modified_base (251)..(251): a, c, t, g, unknown or other
  misc_feature (251)..(251): n is a, c, g, or t
  modified_base (396)..(396): a, c, t, g, unknown or other
  misc_feature (396)..(396): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttanacaatttgatggagaataaaaatttacgcagactccgtgaaggcgattcaccatctccagacgacccttccaaccatacgctgtatctacaaatgaacatggtgacagttgaagacacggctaacttattatgtgacgtaaagtntttcgttggtcgagtcaatcaatgtaggatagggtgctcgacacgtggggaccagggaccacgtggtcaccgtctctcacgcctccaccgacgggccctagtccggtcccttcccccgtggaccctaccctccaccgaacgcgtcctacccgg

SEQ ID NO: 42837 - DNA, 814 bp, Homo sapiens
  misc_feature: GYAE6OF01CKTIX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccgccgacggccccaggccgaagggctgggaggtgggtggctatttagtactaatttgagtaggaagtaattaaaaaattttcgacaagtaccgtcggtaggaacgggccgtacttccacctatcctaccagaccgtacccttacccaaacctactaccgcttacgtactaccctactaaactacgaaacctagtcgggtacgtaacgtaaggttacggaaacgtaaccgtaaaccgggtaaccttaaaacgttttagtttaacgttagggttacgaaccgggttaaaaggttacgttttaccggggtttacgggtttacggaacgtaccgtaagttaccgtaaggtttgggtagggtaaggttacgggggttacggaccgtaccggtaacgtacccgggtagggggacccgtaacggggtaacctaccgggttacgggttacccaacccggttccgtaccccgtacgtaccggtcccccttacccgaaacccggtaaccggggtccccctaacggttcccccgggttccccttacccccccggtcggaccccctaccccccttaccggtaaccccaacggcccgtcccgtaccccggg

SEQ ID NO: 42838 - DNA, 577 bp, Homo sapiens
  misc_feature: GYAE6OF01B30Q3.31.14.B03.1.454.CMB.1.raw
  modified_base (256)..(256): a, c, t, g, unknown or other
  misc_feature (256)..(256): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggctatttanactatttgatggagataaaaaattttacgcagactccgtgaaggccgattcaccatctccagacgacccttccaaccatacgctgtactctaccaaatgaacatcggtagacaggttgaagacgacggactaaactttattattgtagacgaaagtattcggttggttcgagcatcaagtgtggatagggtgctcgacnccgtgggccagggacacgtggtccaccgtctcctcgacgcctcccgaccgacgggcccctagtcccggttcccttccccccgtggcccctaccccttcccgtacccaagccgccgtacccgg

SEQ ID NO: 42839 - DNA, 673 bp, Homo sapiens
  misc_feature: GYAE6OF01EXC2I.31.14.B03.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagcagtagacgtcacgaccggtgctcgatttagtgtgagtagtttgggctgagcgtggtttccgtcgttagctctttaagaggtgtccagtgtcaggtgcacctggtggaatcgtgggggagcgtggtccggccgtggggggtccctgagctctccgtgtgccatgtctgcgtctgaattcatcctcgaggcatatggcatggacncgtgggtcccnccacggccccaggcaagggctgggagtgggngctatttanactatttgagtaggaagtaaattaaaaattttcgacagactaccggtaggaacggccgtattaccaccactcctaccaagaccgtaccccttaccaaacctataccgcttacgtactaccttaaccaaatacgaaactagtagggtanacgtagttaacgaagaacacgtactaaattnttagtgtanacggtaaattgtttccggttgttacgagtactagtactaagttggtaggtaggtacgggtcgtcgtaccgacgtaccgggtagggaccgaaggaaccgtagtcggtaccgtacccgtcgtacccgcacggtccccgtaccgaaccggtaccgggccctagttcccggtacccttcccccgacggacccctaccccgtcctaaccggacgtacgtcccgtaaccggg

SEQ ID NO: 42840 - DNA, 877 bp, Homo sapiens
  misc_feature: GYAE6OF01DCXOA.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggcctggggggtccctgagactctcctgtgccatgtctgcgtctgaattcatcctcaggcactatggcatgcactgggtcccgccacggcccccaggccaagggactggaggtgggtggctagtttatactaagtttgataggaagtaaattaaaaaaattttacggactagacctcccggtaggaaacggggcccgtaatttaccgaacctaacgttccgttaccaacggaaccgtaacccctttacccaaaaccctaacgttaaccggccttacggtaaccttaccttaaaccctaaaagttaacggtaaaaccgtaagttacggggttagaaccgtaaggtttaacggaaaacggaaccggaaaccgggtaactaaaaccgttttaagtttaaacgtttacgggttacgaacggttaaaaacggttaacgtttttccgggtttacgggtttacggaacggtacctaagttaccgtaaagtttgggttaagggtaagggttaacggggttcgggtacccgttaccggaacccgtaaccgggtcgggggtaccgaagggggtaaaccctacgggttacggtacccgtacccgttccttacccgtccgtaaccgtcccgtaccccgaacccgtaaacggggccccctaacggttccccggttacccccgttacccccccggttacggtaccccctaaccccccgttacccttaacccgaaaccggtccgtacccgtaaccccggg

SEQ ID NO: 42841 - DNA, 716 bp, Homo sapiens
  misc_feature: GYAE6OF01EP77K.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcgaggtgcacctggtggaatctgggggaggcgtggtccggcctggggggtccctgagactctcctgtgccatgtctgcgtctgaattcatcctcaggcactatggcatgcactgggtcccgccaggccccaggcaagggactggagtgggtgctatttanactaatttgatggagaataaaaaattttacgacagactccgtaggaagggccgtattcaccatctccagacgacccttaccaaccatacgctagtactcctaccaaatagaactagtggtagacagttagaagacgacggactaaacttattattgtagtacgtaaagtatttcggttaggttcggaagtactaataccaagttggtaggtaagttaggggtgaccgtcggaaccaccgggtcgggggacccgaaggggtaacctacggttacggttacccgtaacccggttccttacccgtaccgaccgtaccccttaccccgaaacccggaaaccgggggaccccccttaaggttccccgggttcccctttaccccccccggtagggtaccccccgtaaccccccgttaccccgttaaacccccgaaacgggtaacccggcccgttaaaccccccgggg

SEQ ID NO: 42842 - DNA, 658 bp, Homo sapiens
  misc_feature: GYAE6OF01D87A2.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggctggagtgggtggcatttanacaatttgatggagataaaaaattttacgacagactccgtgaaggccgattcaccatctccagagacccttccaaccatacgctgtatctaccaaatagaacatggtgacagttagaagacacggacaactttattattgtagacgaaagtattcgttggttcgaagcgaatcaagttggtggtaacgttaggggtggtctcggaaccaccgtgggggacccaagggggtaaaccacgttcgggtacccgtacccggttccttacccgtcgaccgtccccgtacccaaaccccggaaacggggtaccccctaacggttccccgggttcccccgtttaccccccccgtacgggacccctaccccccttccccgaaccccgtaaacggaccgtccctaacccccggg

SEQ ID NO: 42843 - DNA, 685 bp, Homo sapiens
  misc_feature: GYAE6OF01C9A1F.31.14.B03.1.454.CMB.1.raw
tcagcagtagacgtcacgaccggtgctcgatttagtgtgagtagtttaggggtttagggggagacgtacgaaacaggacaggcgaggggcagcaagatggtgttgcagaccctacggtcttctatttctcttgttgctctggatctcgtggtgaccgtaacggggacatcgtgatgagccagttccagcctccctggctgtgtctcgtggggcgaggacgggccaccatcaactgcaagtccagcagagttgtttatcggacccaacaataacaactacttagcttggtaaccaggacaagaaagtaggacacgccctacctaaaactccttagaattttacgcgggtacctttccgaaccccgggctaacggtccccggggtttacccctaaacggtacttttaccgaagtttcggcctagggtccggggttcgtacggggacccgttatttccaacttccaccaacctaatcagtcaacgtctagcgagctagaacgtatgtaggtacttaggtttactcgtatacgatacaaactactttacttaacttttcttccgttacgtaccgtttcggggaacggaaccggggtaacctaaggggttacggagtaaacgttaacggaaaaccgtaggttaggtcgggtacttcgacctaccgtaacttcgtcgttacgttctacccg

SEQ ID NO: 42844 - DNA, 578 bp, Homo sapiens
  misc_feature: GYAE6OF01ANVWE.31.14.B03.1.454.CMB.1.raw
  modified_base (494)..(494): a, c, t, g, unknown or other
  misc_feature (494)..(494): n is a, c, g, or t
  modified_base (542)..(542): a, c, t, g, unknown or other
  misc_feature (542)..(542): n is a, c, g, or t
tcagcagtagacgtcacgaccggtgctcgatttagtgtgagtagtttgggctgagctgggtttccctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtcccgccaggccccaggcaagggactgggagtgggtggctatttatactaatttgatggaagtaataaaaaattttacgcagactccggtgaagggccgattcaccatctccagacgacccttccaaccatacgctgtatcctaccaaatgaacatggtgacagttagaagacgacggctaaactttattattgtagacgaaagtatttcggttggttcgagcatcaatgtaggagtgggtgctcgacaccgtggggccagggacacgtggtcaccgtctccncgacgcctcccgaccgacgggcccctagttcccggtcccttcccccgnggcccctacccctcctacccaacgcgccgtacccgg

SEQ ID NO: 42845 - DNA, 928 bp, Homo sapiens
  misc_feature: GYAE6OF01C84Y7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtggggtcccgccacggccccgaggacgaaagggctgggagtgggtggctatttatactaatttgatggaagtaaattaaaaaaagttttcgactaagtaccgttaccggtaggaacggggccgtaactttaccaaccctattacccttacccgaacggtaacccggtaaccccctttaacccaaaacccctaacttaaccggactttacggttaacttaccctaaaccctaaaagttaccggtaaaaccgtaaggttacggggttaagtaaccgtaagggtttaaacggaaaaccggtaaaccgtaaaccggggttaaccttaaaaccgttttaagttttaaacgtttacgggttaacggtaaaccggttaaaagtttaacggtttttcgggtttacggggtttaacgaacgtaccgttaaagttaacgttaaaggttcgggtagggtaaaggttacgggggtgtaccgttaacccggacggtacccgggtacgggggtaacccggaaacggggtaaccgaaccggtttccgggtaccctaaccccggtttcgtccccgtaaccgtacccggtcccccgtaaccccggaaaccggtaacccggggtacccccctagggttccccccggtttccccccttttcccccggacccggttaccccctaaccccccgtttaccccgaccccgtaaacgggtccccgaccgttaacccccggggg

SEQ ID NO: 42846 - DNA, 729 bp, Homo sapiens
  misc_feature: GYAE6OF01DRTLJ.31.14.B03.1.454.CMB.1.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccnccacggccccaggcgaagggactggaggtgggtggctattttanactaatttgagtaggaagtaattaaaaaacttttcgactagtacgtccgtaggaacggcctagttcaccagtccgtaccggacgtaccccttaccgaacctactaccgtcttagtactactaccaaatgaacagtggtagactaggttagaaacgaccaacggtactaactttatagttagtgtaacgtaagtacgtttcggttggtacagtactatcgaaagttgtagggtaagttagggtcggtcctacggacgtaccgggtcggggacccgtaagggaacctacggtacgggttacccaaccggttcctacccgacgtaacccggtaccccgtacccgaaccccggaaacggggtcccccttaaacgggttccccggttacccccgttttcccccccgagggttaccccccacccccgttacccgtaaacccgaacggtacccgacccgtaccccgttacgggg

SEQ ID NO: 42847 - DNA, 658 bp, Homo sapiens
  misc_feature: GYAE6OF01C2R5Y.31.14.B03.1.454.CMB.1.raw
  modified_base (279)..(279): a, c, t, g, unknown or other
  misc_feature (279)..(279): n is a, c, g, or t
  modified_base (418)..(418): a, c, t, g, unknown or other
  misc_feature (418)..(418): n is a, c, g, or t
  modified_base (469)..(469): a, c, t, g, unknown or other
  misc_feature (469)..(469): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcggggtcccgcccgacgggcccccaagggccgaaaggggtactgggaggttgggggtggactaattttaanactaaattttgataggaagtaaattaaaaaaattttcgacaagtactccggtaggaacgggcctattccaacctatcctaccaagaccgaccccttaccaaccataccgctagtactctacaaatcgaaactatggtanaactagttagaacgacacggtactaaactttattatgtagaacgtaaagtntttcggttggtacgagtacatactagtgtaggtagttagggtgacctcgaacgtaccggngggaccagggaactcgttggcctaccgtcctacgtacgacccgtacctcccgaacgaccgggtccccaggttcccgtccccttcccccgtgacccctaccccgtaccaccgaaacgcgtccctaaccgg

SEQ ID NO: 42848 - DNA, 608 bp, Homo sapiens
  misc_feature: GYAE6OF01BWAH9.31.14.B03.1.454.CMB.1.raw
  modified_base (60)..(60): a, c, t, g, unknown or other
  misc_feature (60)..(60): n is a, c, g, or t
tcagcagtagacgtcacgaccggtgctcgatttagtgtgagtagttagggttaggggganctactaacaggcaggcgaggggctaagactaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattcggccccacaataacaactacttagcttggtaccagcagaaagtaggacagccctacctaaactcctgtactttacgtgggtccttccgtaccccgggctacgttcccggggttacctaaccggtattccgaagtttcggactaaggtccggggttcctacggggacccgtatttccgaacttctacaccattccagccagtccctgaccgtaggctagaagtatagtcggactagtttatacgtgtacagtactaactattactacttcgtttacgtctacgtttcggcggtacgggactaggtgtagacgtacgaaacgtactggtgaccgtgacgtacctactacgtcgtccttcgtaccg

SEQ ID NO: 42849 - DNA, 555 bp, Homo sapiens
  misc_feature: GYAE6OF01AZWSL.31.14.B03.1.454.CMB.1.raw
  modified_base (252)..(252): a, c, t, g, unknown or other
  misc_feature (252)..(252): n is a, c, g, or t
  modified_base (520)..(520): a, c, t, g, unknown or other
  misc_feature (520)..(520): n is a, c, g, or t
  modified_base (545)..(545): a, c, t, g, unknown or other
  misc_feature (545)..(545): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaaattttacgcagactaccgtgaagggccgattcaccatctccagacgacccttcaaccatacgctgtatctaccaaatgaacatggtgacagttgaagacacggcaaactttattattgtgacgtaaagatttcgttggttcagcatcaatgtaggatagggtgctcgacaccgtgggccaagggaacacgtggtccacgtctcctcagccctaccaccgaacgggcccagtccggtccttcccccgnggtcccaaccccttcctaccaacgngtcctacccg

SEQ ID NO: 42850 - DNA, 720 bp, Homo sapiens
  misc_feature: GYAE6OF01DX2KQ.31.14.B03.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (402)..(402): a, c, t, g, unknown or other
  misc_feature (402)..(402): n is a, c, g, or t
  modified_base (466)..(466): a, c, t, g, unknown or other
  misc_feature (466)..(466): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgcacgtgggtccnccacggccccaggcaagggctgggagtgggtgctatttanactatttgataggaagtaaattaaaaatttcgacagtacgtccggtaggaacgggcgtattacacctatcctaccaagtaccgtaccccttaccaaacctagtaccgtctagtactacctaacaaagtacgaaactagtagggtanaacgtaggttagaaacgacgaacggtacttaaactttagttagttacgtagaacgtaaaggttnttacggtttaggtacgagtactaatacgtaagttggtaggaagttaggggtcgtacgtacggaaccgtaccgggtacggggacccaaggggtaacctacggttacggtaccctaccgttccctaccgtaccgaccgtccccgtacccgaacccgaaccgggtcccctacggttccccggttcccccttacccccggtacggtaccccctaccccgttacccgtaaaccgaccggtaccgtcccgtaaccccggg

SEQ ID NO: 42851 - DNA, 879 bp, Homo sapiens
  misc_feature: GYAE6OF01AH3Y1.31.14.B03.1.454.CMB.1.raw
tcagcagtagacgtcacgaccggtgctcgatttagtgtgagtagtttgggtcgtgagctgggttttcctcgttgtctcttttaagtaggtgtccagtgtcaggtgcacctggtggaatctgggggaggcgtggtccggccgtggggggtcccgtgaggactctcctgtgccatgtctgcgtctgaattcatcctcaggcactatggcatgcactggggtccaccaggcccccagggcaaagggggtacctgggacggtgggggttggacctattttatacaatttggatgggaacgtaattaaaaaaacgttttacgacgtaagtaaccgttaccggttaggaaacggggtacccggtaagtttaccaacccgtacttacccgttccgaacggtaacggtaaccccctttaccccaaaaccctacgtttaacccggacctttacgttaacttcctaacccctaaaagttaacggaacctaaacgttgggttacggaacttaacgggtttacgaaaacggtaacccgtaaccggggtaaccttaaaccttttaacgtttagttttacggtacggtaccggtaaaagtaggttttaaccgggtttcgggttaagtaacggaccgttaatacgttaaatcggggtttaggtaacggtttagggggtacggtactacccggtaaccgacgggttccgggggaccgtaaacggggaaccgttaccgtacggggttccaaccccggttcgttaacccgttccgaaacggtcctaaaccccgtaccgggaaacccgggtccctaacgggttcccggttaccccccttcccccggtaaggccccttaccccaaccccgttaccgaaacgcccgtccgttaaccccgg

SEQ ID NO: 42852 - DNA, 767 bp, Homo sapiens
  misc_feature: GYAE6OF01BMHT7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccgccaggcccccaggcgaagggactgggaggtgggtggactagtttataactaatttgaagtggtaagtaattaaaaaaagttttacgacaagtactccggtagaacgggccgattcaccatctaccagacgacccttaccaaccatacgctagtactacgtaccaaatagaactagtaggtacgaacgtaggttaagaacgtaaccgacggtactaaactttattagtttagttacggaacgtaaagttacgtttacggtttaggttacgagtacgtaagttacgtaagttagggtagtaggttaggggtgaccgttacgaaccggtaccgggttcggggaacccgaaggggtaaccgtaccgggttacgggtaccccgtacccgggtttacccttcccgtacgaaccggtccccccttaacccggaacccggtaaacccggtcccgtaacccggttcccggttacccccgttcccccccgggttacgacccccgttaccccccttacccgttaacccgaaaccgtcccggtaccccgttaacccccggg

SEQ ID NO: 42853 - DNA, 708 bp, Homo sapiens
  misc_feature: GYAE6OF01BTDLP.31.14.B03.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttatacaatttgatggaagtaataaaaaattttacgacagactccgtagaagggccgattcaccatcctccagacgacccttccaaccatacgcttagtactctaccaaatgaacatggtanactagttagaagacacggactaaacttattattggtagtacgaaagtactttcggtttggttacgagtcctaattacaattggtaggtagtagggggtggccttcggaaccgtacccggttgggggaccctaagggggaaaccgaccgttagggttaccctaacccgggttccttacccgtaccgtaccgcccccttaccccgaaacccggaaaccggggtccccctaacggttacccccggggttccccctttccccccccgtacggggtacccccctaaccccccgttaccccttaacccccgaaacggtcccggtacccccgtaaacccccgggg

SEQ ID NO: 42854 - DNA, 794 bp, Homo sapiens
  misc_feature: GYAE6OF01CHBZL.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcagtgcacgtcgggtccgccgacggcccccaggcaagggactgggaggtgggtgctatttatactaagttttgagtaggaagtaaattaaaaaaattttacgactaagacctaccggtaggaaacggggcccgtaatttaccaccgtactcctaccaacggaaccgtaacccctttaccaaaacctactaaccgacttagttaactacctaacaaattacgaaacctagtgggtacgaacgtaggttagaaacgaccgaacggtactaaactttaagtttattaggtacggtaacgtaaaaggttacgttttacgggtttagggttaccgaggtacaatacgtaaagttgggtagggtaaggttaggggtacggaccgttaccgaaccggaaccgggtcgggggaacccgaaggggtaacccgtacggttccgggtaccttaaccccggttccgttccccgtaccgaccggtccccctaacccgaaaccccggaaaccgggtccccctaacggttccccgggttacccccttccccccggtcgaccccctacccccttacccgtacccggaaacgtccgtcccgtaaccccggg

SEQ ID NO: 42855 - DNA, 976 bp, Homo sapiens
  misc_feature: GYAE6OF01DCQ04.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccgcgtgggggtcctgagctctctgtgccatgtctgcgtctgtaattcacttcctacgacggactaacgttaagtcgggactaagttcggcctaccggtcggggtccccgaccgaccgggccccgagggaccgaaaggggtacgtggggaggttgggggttgacttaagttttaataacgttaagttttggaagttaggtaaagtaaaaatttaaaaaagtttccgactaagtaccgttaccggtaggaacggggtacctaactttaccaacctacttacccgtaccgaacggtaaccctaccccttacccaaaaccgtactaccgtacgttacgttaacctcctaaaccgtaaagtaacgaaactaggttagggtaacaacgtaagttacggaaacgtaaccgtaacgggtaaccttaaaagtttagtttaacgtttacgggtaacgtaaacggttaaaagttccggtttttacggggtttacgggttaaccgtaacggtacttaaacgttacgaaagggtttacgggttaaggggtaagggtttaacgggggtcggtaccccgttaaccgggaaaccggttaccccggggtacgggggggaacccgtaaaacggggtaacccgttaacccgggtttccgggtaaccccgttaaccccgttcccttaccccggtaccgtaccccggtaccccttaaccccggaaacccgggtaaccccgggttaccccttaacggtttaccccccgggtttcccccgttacccccccgtacgggtaaaccccccttcccccccggttaaacccgtacccggaaaccggtcccggtaccccgtttacccccggggg

SEQ ID NO: 42856 - DNA, 601 bp, Homo sapiens
  misc_feature: GYAE6OF01DVRIX.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggtggcagttttanacaatttgatggaagataaaaaattttacgcagactccgtgaaggccgattcaccatctccagagacccttcaaccatacgctgtaatctaccaaatgaaacatggtgacagttgaaagacacggctaaacttattattgtcgacgtaaagactttacgttgggttacgagtcaatcaatgtaggagttagggtggacctcggacctaccgtggggaccaggggaaacacgtgggtccaccggttctccctcgacgccctcccgaaccgaacggggcccccaagttccggttcccttccccccgtggacccctacccctaccctacccaaacggcgccctaacccgg

SEQ ID NO: 42857 - DNA, 582 bp, Homo sapiens
  misc_feature: GYAE6OF01EJP21.31.14.B03.1.454.CMB.1.raw
  modified_base (253)..(253): a, c, t, g, unknown or other
  misc_feature (253)..(253): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactggagtgggtgcatttanacaatttgatggagaataaaaatttcgcagactccgtagaggccgattcacatctcagacacccttcaaccatacgctgtatctaccaatagaactatggtgactagttagaagtacacggtctaaactttattattgtagacgtaaagtntttcggtggttacgagtcatcaaagtggtggtagtagggtgcgtacgacgaccgtggggaccagggaacncgtggtccaccgtctccgtcacgtccctaccgacccgtaacggcccctagttcccggtcccttcccccgtggcccctacccctaccctaccaacgcgcccgtaacccg

SEQ ID NO: 42858 - DNA, 580 bp, Homo sapiens
  misc_feature: GYAE6OF01AR6GC.31.14.B03.1.454.CMB.1.raw
  modified_base (497)..(497): a, c, t, g, unknown or other
  misc_feature (497)..(497): n is a, c, g, or t
  modified_base (542)..(542): a, c, t, g, unknown or other
  misc_feature (542)..(542): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccgccaggcccccagggccaaggggactgggagtgggtggctatttatacaatttgatggagaataaaaatttacgcagactccgtgaagggccattcaccatctccagacacccttaccaaccatacgcttgtactctaccaaatcgaacagtggtagacagttcgaagacacggactaacttattattgtagacgtaagtattcgttggttcgagtcagtcaagtgtaggagtagggtgacgtcgactacgtgggaccagggacacgtgtaccacgtctccncacgccctaccgaccgacgggcccagttcccgtccgttcccccgnggcccctacccctcctacccaacgtcgtccctacccgg

SEQ ID NO: 42859 - DNA, 612 bp, Homo sapiens
  misc_feature: GYAE6OF01CF4VA.31.14.B03.1.454.CMB.1.raw
  modified_base (578)..(578): a, c, t, g, unknown or other
  misc_feature (578)..(578): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccacggccccaggcaagggctgggagtgggtggctatttatactaatttgatggaagtaattaaaaaaattttacgcagactccgtagaagggccgattcaccatctccagacgacccttaccaaccatacgctgtatctaccaaatgaacagtggtgactagttagaagacacggactaaactttattattgtagacgtaaagtatttcggtttggttacgagtcaatacaagtgtaggagttagggtgcgtacggacctaccggtgggaccgaaggggaactacgtcgggtaccacccggttcctccctacgacgccctacccaaccgacgggcccctagttcccggttcccttcccccgnggccctacccctccaccgaagccgccgtacccgg

SEQ ID NO: 42860 - DNA, 581 bp, Homo sapiens
  misc_feature: GYAE6OF01EEVEF.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (485)..(485): a, c, t, g, unknown or other
  misc_feature (485)..(485): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggcccccaggcaagggactggagtgggtggctatttanacaatttgatggaagaataaaaattttacgacagactccgtgaacgggccgattcaccatctccagacgacccttccaaccatacgctagtactctaccaaatgaacatggtagactagttagaagacacggactaaacttattagttgtagacgtaaagtagttcggttggttacgagctatcaagtggtaggagttagggtgctcgacaccgtggggaccagggacncgtggtaccaccgtctccgcacgccctccaccgacgggcccagttcccggtcccttccccgtggccctaccccgtcctaccgaacgcgcctacccg

SEQ ID NO: 42861 - DNA, 696 bp, Homo sapiens
  misc_feature: GYAE6OF01EI0K4.31.14.B03.1.454.CMB.1.raw
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggctggagtgggngctatttanactaatttgatggagtaattaaaaattttcgacagactccgtagaaggccattcaccatctccagacgacccttccaaccatacgctagtactctaccaaatcgaactagtaggtagactaggttacgaagacgtacggactaacttattattgtagacgtaaagtactttcggttaggttacgagtactatacgtaagttggtaggtagttacggggtcgccgttacggtaaccgtacccgggtgggggacccgaagggggtaacctacggtacgggttaccgtacccggttccttacccgtaccgtaccggtaccccttacccgaacccggtaaccgggtcccccgtaacggtttccccgggttcccccttaccccccggtaggtaccccccgtaacccccttacccgtaaccccgaacggtccgtccccgtaaccccggg

SEQ ID NO: 42862 - DNA, 683 bp, Homo sapiens
  misc_feature: GYAE6OF01C7Y0E.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccacggccccaggcaagggactggagtgggtgctatttatacaatttgatggaagaattaaaaaattttacgacaagactccgtagaagggccattcaccatctaccagacgacccttacaaccatacgctgtactcctaccaaatgaaactagtggtagacgtagttagaagaccacggtactaactttattattgtagaacgtaaagtacgtttcgtttaggttacgaagtacaattacaagttggtaggtagttaggggtcggcctacggaccgtaccggtacgggggaccgaaggggaacctacgttcggtaccctaccgttcctccctcgaccgtccctacccgaacccggaaccgggtcccctaacggtttccccgggttacccccgtttcccccccgtcgggtaccccctaccccccgttccccgtaaccccaaacggtcccggtacccgttaacccccggg

SEQ ID NO: 42863 - DNA, 676 bp, Homo sapiens
  misc_feature: GYAE6OF01DLRXM.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgtctgaattcatcctcaggcactatggcatgcacgtcgggtccnccgaggccccagggcaagggacgtggaggtgggtgcattttagactaatttgatggaagtaaattaaaaatttcgacagactccgtgaaggcgtatcacatcaccagacgtacccttccaacactacgctgtactcctacaaagtcgaaactagtggtagacgtaagttagaacgacacggactaaactttattattaggtacgaacgtaaagtacgtttgttagggttacgagtactaagtactaaagtggtagggaacgttaggggtacgcttccggaaccgtacccgggtagggggtcccaaagggtaccgtaccgttacgggacctacccggttcctaccctcgaccgtaccccgtacccaaccggtaaccgggcccctaggttccccgggttcccctttcccccggacggtcccctaacccgtcccttaaccgacgtaccggccctaacccggg

SEQ ID NO: 42864 - DNA, 900 bp, Homo sapiens
  misc_feature: GYAE6OF01CL5W8.31.14.B03.1.454.CMB.1.raw
  modified_base (86)..(86): a, c, t, g, unknown or other
  misc_feature (86)..(86): n is a, c, g, or t
tcagcagtagacgtcacgaccggtgctcgatttagtgtgagtagtttgggctgagcgtggtttcctcgttgctcttttaagaggtntccagtgtcaggtgcacctggtggaatcgtgggggagcgtggtccggccgtgggggtccctgagctctcctgtgccatgtctgcgtctgaattcatccctcgaggctacttagtggacatcgacacggtcggggtcccgccgaacgggcccccagggaccgaaaggggtactgggaggtggggtaggtactaattttataacgtaaagttttggaagttaaggaaagtaaaagtttaaaaaaacttttccggaacaaacggtacccttaccggtaaggggtaaccgggtacccgttaactttaccgaaccctaacgttccctaacccgaacggtaaaccccgttaaccccctttaacccgaaaaccctaacgttaacccggtactttaccgtaactacccttaaaccgtaaaattacgtaaaccgtaacgttagggtaacgtaaacggtaagttaacggaacgtaacccgaacggttaaaccttaaacgttttatttaacggttggtaccggtaaaggttaaacggttcgttttaccgggtttaggttacccgaaagtaccgtaaagttaccgtaaaggttcgggtaagggtaaggttcgggggtctaacccgtacggaaccggtaccggtacgggggtaacccgaagggtaacccgtacggttcggtaccaaccccgttcgtacccacggtaccgtccccgtaccgaaacccgggtaccggtaccccgttaccggttccccggttccccctaccccggtaccgaccccccttacccgtaccctaccgaacggtacccgccgttaaccccgggg

SEQ ID NO: 42865 - DNA, 708 bp, Homo sapiens
  misc_feature: GYAE6OF01CGSA1.31.14.B03.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagacctctcctgtgccatgtctgcgtctgaattcatcctcaggcactatggcatgcacgtgggtccnccacggcccaggcaagggactgggagtgggtgctatttanactaatttgagtaggaagtaattaaaaaattttacgacaagtactccgtaggaacgggccgtattcacatctaccagacgtacccttacaaccatacgctagtactactactaaatcgaaactagtaggtacgacgtaggttaagaacgtaacgacggtactaaactttagttagttgtaggtaacgtaaagtagtttacggttaggttacgagtactaatacgtaaagttggtaggtaagttacggggtcgtaccgtacgacgtaccgggtacggggaccgaaggggtaacctacggttcggtacccgtaaccgtccctccgtacgtaccgtacccctacccgtaaaccgaaccggggtcccctaagggttccccggttaccccgttcccccgtacggacccccttacccccgtaccctacccgaaacggtccgtcccgttaaccccggg

SEQ ID NO: 42866 - DNA, 564 bp, Homo sapiens
  misc_feature: GYAE6OF01BY372.31.14.B03.1.454.CMB.1.raw
  modified_base (253)..(253): a, c, t, g, unknown or other
  misc_feature (253)..(253): n is a, c, g, or t
  modified_base (485)..(485): a, c, t, g, unknown or other
  misc_feature (485)..(485): n is a, c, g, or t
  modified_base (554)..(554): a, c, t, g, unknown or other
  misc_feature (554)..(554): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttcgcagactccgtgaagggccgattcaccatctccagacgacccttccaaccatacgctgtatctaccaaatgaacatggtgacagttgaagacacggcaaactttattatttgtgacgtaaagtatttcggttggttcgagctaatcaatgtaggtatagggtgctcgacaccgtggggccagggacacgtggtccaccgtctccncagccctccaccgaacgggcccctagtcccggtcccttccccccgtggcccacccttcccacccaacgngccctacccg

SEQ ID NO: 42867 - DNA, 995 bp, Homo sapiens
  misc_feature: GYAE6OF01BLGOR.31.14.B03.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggtcccnccacggccccaggcgaagggactgggaggtgggtgctatttanactatttgagtaggaagtaaattaaaaaattttcgactagtacctccggtaggaacgggccgtatttaccaaccgtattccgtaccaacggtaacgtaaccccctttacccaaacctacgtaaccgtccttacgttaacttacctaaccctaaaagttacgaaaaccgtaagttacgggttaacgaaccgtaaggtttaacggaaaacggaacccggtaaacccgggtaaccttaaaaaccgttttaagttttaaacggtttacgggttaacgggtaaccggttaaaaacggtttaacggtttttacccgggggttttaacgggttttaacccgggtaaacgtaacccgttaaagttaacccgttaaaaggtttcgggttaacggggttaagggtttaacgggggttacgggtacccgtttaacccggaacccggttaaccccggggttacggggggaaccccgtaaagggggtaaacccgtaccgggttaccgggtttaacccgtaccccggtttcccgttacccccgttaccggtaacccggttaccccccgtaacccccggtaaaacccgggtaacccccgggggtaaccccccttacccgggtttaccccccggggtttacccccctttacccccccccgggttacgggtaccccccccttaacccccccggttacccccgttaaaccccggaaaaccgggtaccccgtccccccggttaaacccccggggg

SEQ ID NO: 42868 - DNA, 791 bp, Homo sapiens
  misc_feature: GYAE6OF01DG5OP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtcccgccacggcccccaggccaaggggactgggaggtgggtggctatttatactaaatttgataggaagtaattaaaaaaattttcgactagtaacgtccgtagaacggggtccgaattccaaccattcctccgaagacgtaccccttaccaaacctattaacggcttgtaacttcctacaaaatcgaaacctagttaggtagaactaaggtttagaaacgtaaccgaacgggtactaaacgtttatttaagttaggttacggaacgtaaaggtacgttttaccggttaggggtttaccgtaaggtcctaacgttacgtaagtttacgggtagggtaaaggttacgggggtcggtacccgttacgaacccggtaacccgggttaggggggaccccaaagggggtaaccctacgggttacgggttaccaccccggtttccgtaccccgttcgaaccggtccccgttacccgaaacccggtaaccggggtcccctaagttccccgggttcccctttaccccccgtcgggtacccctacccccgtacccttaaccgaaacgggtccgtcccgtaaccccggg

SEQ ID NO: 42869 - DNA, 771 bp, Homo sapiens
  misc_feature: GYAE6OF01EATFV.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactgggagtgggtggctatttatactaatttgataggaagtaattaaaaaattttacgacagtaccgtccggtaggaacggggccgtaacttcaaccgattcctaccgaagaaccgtaccccttaccaaaccaacgttaaccgcttacgttaactacctaacccaaagttacgaaactaagttagggtacgaacgtaaggtttacggaaacgaaccgtaaccgggtaacttaaaacctttaagtttaacgtttgggtaacggtaacggttaaaaggtacgtttttaccggttagggtttacggaacggtactaagttacgtaaagttgggtaagggtaaggttacggggtcgtaccgtaccgggtacaacccgggttcggggggacccgaacggggtaacctacggttacggttacccgtacccgttacctccctaccgaaccgtccctacccgaaccgaaccgggtcccctagttcccggttccccttaccccgtcgcccctacccccgtcctacccgaacgtcgcccgtaccggg

SEQ ID NO: 42870 - DNA, 719 bp, Homo sapiens
  misc_feature: GYAE6OF01EJH6I.31.14.B03.1.454.CMB.1.raw
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatcgtgggggagcgtggtccggccgtggggggtccctgagactctcctgtgccatgtctgcgtctgaattcatcctcgaggctactatggcatgcacgtgggtcccnccacggccccaaggcgaagggcgtgggaggtgggtgactatttaanactaatttgataggaagtaaattaaaaaattttcgacagtacttccggtaggaacggccgtagttcaaccgatcctaccgagtaccgtaaccccttaccaacctataccgtcttacgtactactaaccaaagtcgaaactagtggtagactagtagaacgtacgacgtactaactttagttatggtagtacgtaagtcgtttagttggtacgtagactaatacgtaagtaggtaggtaagtagggtcgtacgtaccggtaacgtaccgggtaggggtacccgaagggtaacccgtacgttcggtaccctaacccgttcgtacccgtacaaccggtccctacccgtaaacccggaccggggtccccctaaggtttccccggttaccccttccccccggtcggacccccttaccccctacccgtaacccgaaacgcccgtaacccgtacccccggg

SEQ ID NO: 42871 - DNA, 559 bp, Homo sapiens
  misc_feature: GYAE6OF01EYY4Z.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (405)..(405): a, c, t, g, unknown or other
  misc_feature (405)..(405): n is a, c, g, or t
  modified_base (449)..(449): a, c, t, g, unknown or other
  misc_feature (449)..(449): n is a, c, g, or t
  modified_base (488)..(488): a, c, t, g, unknown or other
  misc_feature (488)..(488): n is a, c, g, or t
  modified_base (530)..(530): a, c, t, g, unknown or other
  misc_feature (530)..(530): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccncaggccccaggcaagggactggagtgggtgcatttanacatttgatggagataaaaatttcgcagactcgtgaacggccgtatcacatctcagacgacccttccaacatacgctgtactctaccaaatgaaccagtggtcacgtagttagaagacaacggtactaaacttattattgtagacgtaaagtntttcggtggttcgagctatgaagtgtggagtgggtgctacgacncgtgggaccagggaactcgtcggtccaccgtctccgacncgccctaccgaccgacggccctagtcccggtcccttccccgngccctaccctacctacacgcgccgtaccg

SEQ ID NO: 42872 - DNA, 606 bp, Homo sapiens
  misc_feature: GYAE6OF01EA4NM.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgctatttanacaatttgatggaagtaataaaaaattttcgcagactccgtgaagggccgattcaccatctccagacgacccttccaaccatacgctgtatctaccaaatgaacatggtgacagttagaagacacggactaacttattattgtgacgtaaagtntttcgttggttacgatcaatcaagtgtaggagtagggtgctcgacaccgtggggccaagggaacacgtcggtcacccgtctaccctcacgtccctaccgaacccgaacgggtcccctaagttcccggttccccttcccccccggtgggtaccccctacccccgttacccctacccgaaacggccgtcccgtaaccccgg

SEQ ID NO: 42873 - DNA, 679 bp, Homo sapiens
  misc_feature: GYAE6OF01EE74K.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccaggcaagggactggagtgggtgctatttatactaatttgataggaagtaattaaaaaattttacgacagactccggtagaacgggccgattcaccatctaccagacgacccttaccaaccatacgctgtatcctaccaaatacgaactagtggtagactagttagaacgacgacgactaactttatttacgttagtagtacgaaagttacgtttcggttaggttacgtagactaattacgaaagttggtagggtagttaggggtcgtaccgtcggtaaccgaccggtcgggggacccgaaggggaacctacggttcgggtacccgtacccggttccttacccgtccgaacgtccccctacccgaacccgaaccgggcccctaacggttcccggttccccttaccccccggtcggacccctaccccctccctaccccaaggccgtccgtaccccgg

SEQ ID NO: 42874 - DNA, 598 bp, Homo sapiens
  misc_feature: GYAE6OF01EL51P.31.14.B03.1.454.CMB.1.raw
  modified_base (258)..(258): a, c, t, g, unknown or other
  misc_feature (258)..(258): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccagggcccccaggccaagggactgggagtgggtggctatttanacaatttgatggagtaataaaaatttacgacagactccgtagaagggccgattcaccatctccagacacccttccaaccataccgctagtatacctaccaaatgaactagtggtagactagttagaagacgacggactaaacttattattgtagacgtaaagtatttcgttggttcgagcatcaagtgtaggagtgggtgctcgacncgtcggggaccagggaacacgtcggtccaccgtcctcctcacgccctacccgaaccgaacgggcccctagttcccggtcccttccccccgtggccccctaccctccctaaccgaacgtccgcccgtaacccgg

SEQ ID NO: 42875 - DNA, 558 bp, Homo sapiens
  misc_feature: GYAE6OF01BC9HA.31.14.B03.1.454.CMB.1.raw
  modified_base (523)..(523): a, c, t, g, unknown or other
  misc_feature (523)..(523): n is a, c, g, or t
tcagcagtagacgtcacgaccggtgctcgatttagtgtgagtagtttgggctgagctgggtttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggctggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgacgaagatttcgttggttcgagcatacaatgtggatagggtgctcgacaccgtggggccaggggaacacgtggtccaccgtctcctcacgccctccgaccgaacgggccctagtccggtcccttccccccgngggtacccacccctcctaccaacgcgcctacccgg

SEQ ID NO: 42876 - DNA, 660 bp, Homo sapiens
  misc_feature: GYAE6OF01CLGWH.31.14.B03.1.454.CMB.1.raw
  modified_base (409)..(409): a, c, t, g, unknown or other
  misc_feature (409)..(409): n is a, c, g, or t
  modified_base (640)..(640): a, c, t, g, unknown or other
  misc_feature (640)..(640): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggccgcacggccccaggcaaagggctggagtgggtggcatttatactaatttggataggtaagtaaattaaaaaacttttacggactaagtaccgtaccggtaggaaacggggccgtaatttccaacctatcctaccgagtaaccaccccttaccaacctataccgctcgtactcctacctaaatcgaactagtcggtanacgtagttaagaacgacgtacgtactaaagttatttagtagtacgagaaacgttcgttacgtcgttacgagtatacgtagaagtgtagggtagttaagggtctacggttacgaccgaccgggtagggaccgtaacgggtaacctacggttcggcctaccggtactcctacgaccgcccgtaccgaccgtacggccgtagttcccgtccgtcccgtccgaccgtcccaaccncgtaaacgcgtccctacggg

SEQ ID NO: 42877 - DNA, 877 bp, Homo sapiens
  misc_feature: GYAE6OF01C410N.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttggctgagcgtggtttccctcgttcgcgtctttttaagaggtgttccagttgtcaggtgacgacctggtaggaatcgtgggggaacgtcgtcggtccggccgtggggggttcccgtgaggactctccgttgtttgccagtgttacttaggcgtctagtattcagttccncaggctacgtagtggcaggtgcctacggtcgggtccggcccgggacggtccccgaggaccgtaagggtccttgggacgtgggtggcctagttttagtaccgtaatttacgtagtagggaactaagttaaaaaacttttacgaccgtaacgtaacgttcccggtaacggtaaccggggaccccgtaaccgtttaccgaaccccgtaacgtacccggtacccgtaaggtaccggtaacccccggtttacccgaacccgtacgttaaccggtacgttacgttacgttaacccgttacgtaaaacgttacggtaaacctaagttaacgggtacgtaaccgtaacggttttacgaaaccggtacccgaaccggggtacctaaaccgtttttaacgttaacgttacggttcgaaaccggttaaacgtaggttttaccggttacggtttaccggaagtacgtaactacgtacgttagtaggtacgttaggtacgtacgtacgactccggtaggaccgtaacgggaaccaccggtacgtaccgtacccgttccgtaccgttactaccgtacctcccgaaccgtaacggtcccggtaggttcccggtccgttaccccccgttggccccttacccgttacgttacccgaacggtcccgtccggtaacccggg

SEQ ID NO: 42878 - DNA, 792 bp, Homo sapiens
  misc_feature: GYAE6OF01DKGGQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccacggccccaggacgaagggactggaggtgggtggctatttatactaatttgagtaggaagtaaaatttaaaaagttcgacgtacgtaccgtacggtaggaacggtactactaccactactccacgaacgtacctaccctaccaactagtaccgtcttagtactacctaactaaagtacgaactagttaggtagtaacgtagtaacgaacgtacgaacggtacttaaagtttagttacgttaggtaacggtaaacgttaaaggtttcgtttacggggttacggttaacgaacttaactaacgtaagtaaggttaggggttaagggtaacgggttaacgggggtcgtacccggttaacccgaaccgggtacccggggtaacggggaacccggtaaaacggggtacctacgggttaccggtacccgttacccgttccctacccgaccgtacggtccccctaaacccggaaccggtacccgggtccccttacgggttcccccgttccccgttacccccggtacggtacccccctaccccttaccgaaacccgacgggtcccgtacccgtacccgggg

SEQ ID NO: 42879 - DNA, 565 bp, Homo sapiens
  misc_feature: GYAE6OF01BAPPV.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (361)..(361): a, c, t, g, unknown or other
  misc_feature (361)..(361): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagaataaaaaattttacgcagactccgtgaagggccgattcaccatctccagacgacccttccaaccatacgctgtatctaccaaatgaacatggngacagttagaagacacggactaactttattattgtagacgaaagtatttcgtttggttcgagctaatcaagtgtaggtagtagggtgctacgacaccgtgggaccaagggacacgtcggtccaccgtctcctcacgcctccaccgaacggccccagtcccggtccttcccccgnggccctaccctccaccaacgcgtctacccg

SEQ ID NO: 42880 - DNA, 677 bp, Homo sapiens
  misc_feature: GYAE6OF01B4ZOB.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccacggccccaggcaagggactgggaggtgggtggctatttanactaatttgatggaagaattaaaaaaagttttacgcaacgactccggtaggaaaggggccgtattcaccatacctaccgagacgtacccttaccaaccactacgctagtatcctaccaaatcgaaacagtggtagaactagttagaaacgacacggactaaacttatttacgttgtaggacgtaaagtatttcggttaggttcgagctaagtcaagtgtaggtagtagggtcgctacgacgaccggtggggaccgaaggggaaccacgttcggtacctaccggttcctcccgtacaccggtcccctaccgtaacccgaacgggtccccctaacggttccggtccccgttttcccccccgtgggtacccccctaccccgttcccctaccccgaaagggtcccggtacccgtaccccgg

SEQ ID NO: 42881 - DNA, 735 bp, Homo sapiens
  misc_feature: GYAE6OF01CHX8L.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcaatgcacgtgggtccnccaggccccaggcaagggtctggagtgggtgctatttanacaatttgataggaagtaattaaaaaattttcgacaagtacctccggtaggaacgggccgtatttccacctacttcctccgaacgtaaccgtacccttacaacctactaccgcttaggtactcctactaaaacgtcgaaacctagtaggtcgaacgtaggttacgaaacgtacgacggtacttaaactttacgtttagtcggttagacgtaaaggttacgtttcgttaggttaccgagtactaagtaactaagttgggtaaggtaggttacggggtacgcccgttaccgacggtacccggtcgggggtaacccgtaaggggaacctaccggtttcgggtaccctaccggttacctcccttacggaccgtaccccgttacccgaaacccggaaccgggtccccttaggttccccgggttacccctttccccccggttgaccccccgttacccttaccctaccgaaacgccgtcctaaccccgg

SEQ ID NO: 42882 - DNA, 643 bp, Homo sapiens
  misc_feature: GYAE6OF01EEDBY.31.14.B03.1.454.CMB.1.raw
  modified_base (261)..(261): a, c, t, g, unknown or other
  misc_feature (261)..(261): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccacggcccccaggcaaggggactgggagtgggtgctattttanactaatttgatggaagaattaaaaaattttacgacagactccgtagaagggccgattcaccatctccagacgacccttccaacatacgctgtatctacaaatgaacatggtnactagttagaagacaacggactaactttaattagttgtagacgaaagtagtttcggttgttcgagcaattcaagttgtagggtaattacggggtggaccttacggaccgtaccgtcgggggaccaacggggaactacgtcggttacctaccggttcctaccgtccacgaccctcccaaccgtaaccgggcccctacgttcccggttccccttccccccgtcgggacccctacccccttccccgtaacccgaacggccgcccgtaccccgg

SEQ ID NO: 42883 - DNA, 697 bp, Homo sapiens
  misc_feature: GYAE6OF01BG70R.31.14.B03.1.454.CMB.1.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccnccacggccccaggcaagggctgggagtgggtgctatttanactaatttgatggaagtaattaaaaaatttcgcaagactccgtaggaacgggccattcaccatcctaccgagacgtaccccttccaaaccgatacgtctagtactcctaacaaatcgaaacagtggagactagtagaagaccgacgactaacgtttaattagttagtagaacggtaaagtcgtttgggtttagggttaccgaagtccgtaattacgtaaagttgggtaggtaaggtaggggtcggtacctacggaccgtaccggtgggggacccaaagggggtacctacggtcggtaccgtacccgttctccctcgaccgtccccgtacccgaacccggtaaaccgggtccccttaaggttccccggttccccgttccccccgtagggacccccttcccccgtacccttaacccggaacggtccgtcccgtaacccggg

SEQ ID NO: 42884 - DNA, 889 bp, Homo sapiens
  misc_feature: GYAE6OF01B9LYS.31.14.B03.1.454.CMB.1.raw
  modified_base (559)..(559): a, c, t, g, unknown or other
  misc_feature (559)..(559): n is a, c, g, or t
tcagcagtagacgtcacgaccggtgctcgatttagtgtgagtagtttgggttagggggaaggctacaacaggcaggcgaggggccagccaaggattggtgttgtcagtacccgaggtcttcagtttctctagttgctcgtagatcctgtgggtgtccggtacggggactacgttcggtgttattggacgtcccttaagtttttaaccaggtaccttcccgtgggtccgtggttcgtctacggtcgggacggagggaccgggtcccaaccgggacttaccgtaaacgtcggaccgtaaccgggttccggaacgtaccgaaggttacgttttcgtttttaccggttccgggaccccctaaaccgtaaattaaacccgtaacgtttaacgtttaacgttcccgttttacgggttaaacccttacggtaaccgttaaagggtaaaaacggttcggaaaccgttacccgggtaccccttaaaccccgttaaaaacccgttcccgttaagggttaaaccgtttaccgggtcgggttaccggttttaacccggtaacccgggggtntaaaccccggtttaccccggggtttaacctaaaaccggttcgtcgtaaagttcggaacgtacggtaaccggggtacgtacgggtacccgtattccacttcgtaccacgtactactacgctacgtcctcgacgagacgtagactagtcgtacgtactttagttactaccgtagtaacgtcaactaactacgttactaccgtttcgtacgtacgttaccgttcgggacgtacgggtaacgtaggtacgtacgtacgtaaccgtaacgtacgttcggtaccggtccttaccggccttaccgtagttaccgttccgttaccggtcgttaccccg

SEQ ID NO: 42885 - DNA, 767 bp, Homo sapiens
  misc_feature: GYAE6OF01BI2OK.31.14.B03.1.454.CMB.1.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
tcagcagtagacgtcacgaccggtgctcgatttagtgtgagtagtttgggcgtgagctgggttttcctcgttgcctcttttaagaggtgtccagtcgtcaggtgcacctggtggaatctgggggagcgtggtccggcctgggggtccctgagactctcctgtgccatgtctgcgtctgaattcactcctcaggcactatgggacatcgccacgtcgggtccnccagggcccccaggtcaaggggactgggacgtgggtggctaagtttanactaatttgagtggaagaattaaaaagtttcgacagacctccggtagacggccgattcaccatctccagacgacccttaccaaccactaacgctagtactcctaccaaatcgaactagtgggtatacgtaggttagaacgacgaacggtactaactttattagttcgtacgtaacgtaaagtctttcggttaggttacgacgacgtactacgtaagttcgggttaggtaagttacggggtagtccgttacggtaaccgtacccgggtacggggaccctaaggggtaaaccctaccggttacgggttacccgacccggttccttacccgtaccgtaccggtaccccgtacccggaaaaccccggtaaccggggtacccccttaacggttacccccggggtttaacccttccccccccccgggttaagggtaccccccgtaaaccccccgttcccgttaaaccccggaaacccgggtaccgtaccccgtaaaccccggg

SEQ ID NO: 42886 - DNA, 592 bp, Homo sapiens
  misc_feature: GYAE6OF01EFVB2.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagtaataaaaaatttcgacagacttcgtgaagggccgtattcaccatctccagacgacccttccaaccatacgctgtatctaccaaatgaacatggtagactagttagaagacacggactaacttattattgtgacgaaagtattcgttggttacgagtcatacaagtgtaggagtagggtgctcgacaccgtggggaccaaggggacacgtggtaccaccgtctccctcgacgccctaccgacccgaacgggtcccctagttcccgggttcccttccccccgtggaccccctaccccttcccgtacccaaacggcgcccgtacccgg

SEQ ID NO: 42887 - DNA, 736 bp, Homo sapiens
  misc_feature: GYAE6OF01ADOWE.31.14.B03.1.454.CMB.1.raw
  modified_base (218)..(218): a, c, t, g, unknown or other
  misc_feature (218)..(218): n is a, c, g, or t
  modified_base (632)..(632): a, c, t, g, unknown or other
  misc_feature (632)..(632): n is a, c, g, or t
  modified_base (656)..(656): a, c, t, g, unknown or other
  misc_feature (656)..(656): n is a, c, g, or t
tcagcagtagacgtcacgaccggtgctcgatttagtgtgagtagtttgggctgagcgtggtttcgtcgtagctctttaagaggtgtccagtgtcaggtgcacctggtggaatcgtgggggagcgtggtccggccgtggggggtccctgagctctcctgtgccatgtctgcgtctgaattcatcctcaggcatatggactatggcacgtcggggtcccnccgacgggccccagggcgaaagggtctgggaggtgggtgactaatttatactaatttgagtaggaagtaaattaaaaaagttttccgacgtaagtaaccgttccggtaggaaacggggcctaactttaccaaccctaattccgtacccaaggtaccgtaaccctactaaacccaataccgacgttactacttacctaacccgtaattaacgaaaccgtaacgtagtaggtaacgtaacgtaaggtaacgaacgaacggtactaacctttaatttaagttcggttacgtaaccggttaaagtaacggtttacgtttagggttacgacgttacgtaactacgtaagttagttaggtaacggtaagggttcggactcgaacgtccggtaggccggtaacggaacgtacgtcgtaacncccgtaccgtccacgccgtacccnccaaacccggaccgtcccgacttcccggccctttaccccgcccgtaccctccccacgtacccagtaaccgcgtaacccgg

SEQ ID NO: 42888 - DNA, 621 bp, Homo sapiens
  misc_feature: GYAE6OF01DKN16.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggccccaggcaagggactggagtgggtgctatttatacaatttgatggagattaaaaaatttacgacagactccgtgaagggccgattcaccatctccagagacccttccaaccatacgctgtatctaccaaatgaacatggtagacagttagaagacacggcaactttattagttgtagacgtaaagtactttacggttgttacgagtccaagtcctaaagtgtaggaagttaggggtggccgttcgaaccgtaccgtcgggggtaccaagggggtaaccacgttacgggtccaaccgttcctccctcgacgtccctacccaccgaacggggcccctatcccgggttcccttccccccgtggacccctacccccttccctacccgaacgcgcccttacccgg

SEQ ID NO: 42889 - DNA, 604 bp, Homo sapiens
  misc_feature: GYAE6OF01BI418.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (484)..(484): a, c, t, g, unknown or other
  misc_feature (484)..(484): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtggctatttanacaatttgatggagaataaaaattttacgcagactccgtgaagggccgattcaccatctccagacgacccttaccaaccataccgctgtactctaccaaatgaaccatggtgaacagttagaagaccacggctaaacttattattgtgacgtaaagtacgtttcgttggttacgagtactatactaatgtaggagtagggtgctcgacgtaccgtggggaccaagggaacncgtcggtccaccgtctcctcgacgccctaccgaaccgaccgggccctaggtcccggttcccttcccccccgtaggtacccctaccccgttccccacccgaacggtccgcccgtaccccgg

SEQ ID NO: 42890 - DNA, 595 bp, Homo sapiens
  misc_feature: GYAE6OF01AWGZ5.31.14.B03.1.454.CMB.1.raw
  modified_base (260)..(260): a, c, t, g, unknown or other
  misc_feature (260)..(260): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctgagactctcctgtgccatgtctgcgtctgaattcatcctcaggcactatggcatgcacgtgggtccgccacggccccaggcaaggggctgggagtgggtggctatttanactatttgatggagtaataaaaaattttacgacagactccgtggaagggccgattcaccatctccagacgacccttccaaccatacgctgtatctaccaaatagaacagtggtagactagttagaagacgacgggactaaacttattattgtagacgtaagtatttcgttggttacgagacatacaatggtaggagtagggtgctcgacaccgtgggaccagggacacgtcggtcaccgtctcctcgacgcctaccgaaccgacgggccctagtcccggttcccttcccccgnggacccctacccctaccctacccaacggtcgcccgtacccgg

SEQ ID NO: 42891 - DNA, 741 bp, Homo sapiens
  misc_feature: GYAE6OF01DN4V9.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggccaagggactggagtgggtggcatttanacaatttgatggagaataaaaatttcgacagactccgtgaagggccgattcaccatctccagacgacccttccaaccatacgctgtatctaccaaatgaacatggtgaacagttagaacgacacgggactaacgtttattagttagtgtaccggaaagtacgttacgtttggtttacgagtaccaataccgtaaattgggtagggtaagttacggggtagggttccctaccgggtaacccaaccgggtcgggggggtacccaaaggggggtaaaccctacggttacggggttaccctaaccccgggttcttaccccttaccgtaaaccggccccctttaaccccgaaccccggtaaacggggggtccccccctaaacggttttccccgggttaccccctttacccccccccgttaggggaccccctaaaccccccggttacccccgttaaccccgaaaacgggtcccgtccccgtaaaccccccggg

SEQ ID NO: 42892 - DNA, 800 bp, Homo sapiens
  misc_feature: GYAE6OF01BJ8RQ.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccacggccccaggcaagggactggagtgggtgctatttanactaatttgatggaagtaattaaaaaattttacgacagtacgtccgtaggaacgggccgtattccaccatacctccaacgacgtacccttaccaaccataccgtctagtactctaccaaatacgaaactagtagggtacgaacgtagttaggaaacgaccgacggtacctaaactttaattagttaggtacgtaacgtaaaaggttacgtttaccggggttaggtttaccgacgtactaagttactaaagttcgggtagggtaaggttaggggtcggtaccgttacggaaccgtacccgggtacgggggaaccctaagggggtaacccgtacggttaccgggttaccctaacccggttcccttacccgtacccgtaccggtacccccgttacccgaaaccccgggtaaacccggggtccccttaaccggttcccccgggtttacccccgtttaccccccccggtacgggtacccccccttaacccccccgtttaccccctaacccggtaaaacccgggtcccggtacccccgttaaccccccgggg

SEQ ID NO: 42893 - DNA, 614 bp, Homo sapiens
  misc_feature: GYAE6OF01EF7GH.31.14.B03.1.454.CMB.1.raw
  modified_base (216)..(216): a, c, t, g, unknown or other
  misc_feature (216)..(216): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccnccaggccccaggcaagggactgggagtgggtgctatttatacaatttgatggaagtaataaaaaatttacgcagactccgtgaagggccgattcaccatctccagacgacccttccaaccatacgctgtatctacaaatgaacatggtagactaggtgaagacgacggactaacttattattgtagacgaaagtnttcggttggttcgagcatacaagtgtaggtagtagggtcgactcggacgtccggtaggggcccaaggggaaccacgttggtccacccgttctcccgtcacgccctacccgaaccgtaaccgggcccctagtcccggttcccctttcccccccggtaggtccccctaacccccgttccctaacccgaacggcgccctaccccgg

SEQ ID NO: 42894 - DNA, 763 bp, Homo sapiens
  misc_feature: GYAE6OF01CG1ZL.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcatgcacgtgggtccncacggcccaggcaagggctgggagtgggtgctatttagactaatttgagtaggaagtaaattaaaaaagtttcgactaagtaccgtaccggtaggaaagggtcctaacttacacctaactccgtaaccgacggtaacctaccccttaccgaaacctaacgttaccggcgtttactaacttaccctaactaaaacttacggaaactaagttggggtactaacggtaacgttaggaaacgacgtaacggtaccttaaagtttagttacgtttaggacgtaacgtaaagttcgtttcggtttaggtacgagtactaatcgtaaggtcggtaaggtagttacgggtacgtaccgtacggactaccgggtacggggaccgaaacgggtaactaccgttacggttacccgtaacccgttccgccttaccgacccgtcccggtaaccccgaacgtacccgggtacccctaggttaccccgggttcccctcccccggtacggacccccttaccccgtaccgtacccgaaaggtccccgtaacccgttaccccggg

SEQ ID NO: 42895 - DNA, 548 bp, Homo sapiens
  misc_feature: GYAE6OF01AKSWN.31.14.B03.1.454.CMB.1.raw
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttatacaatttgatggagataaaaaattttacgcagactccgtgaagggccgattcaccatctccagacgacccttcaaccatacgctgtactctaccaaatgaacatggtgacagttgaagacacggctaacttattattgtgacgaaagatttcgttggttcgagcatactaatgtggatagggtgctcgacaccgtgggccagggacacgttgctaccgtctccncncgcctccaccaacgggcccatcccggtccttcccccctggccctacccctccctacccagcgcctacccgg

SEQ ID NO: 42896 - DNA, 676 bp, Homo sapiens
  misc_feature: GYAE6OF01AQXD3.31.14.B03.1.454.CMB.1.raw
  modified_base (126)..(126): a, c, t, g, unknown or other
  misc_feature (126)..(126): n is a, c, g, or t
  modified_base (603)..(603): a, c, t, g, unknown or other
  misc_feature (603)..(603): n is a, c, g, or t
tcagcagtagacgtcacgaccggtgctcgatttagtgtgagtagtttggtcgttggagctgggttttcctcgttgctcttttaagaggtgtccagtgtcgacggtgcactgtcggagtctcggggngcgtggtccgcgtggggtccctgagactctctgtgccatgtctgcgtctgaacttcatccctcaggcactatcggcatcgcacgtcgggtcccgccacggcccctaggccgaagggacgttgggaacgtgggtggacctacgttttattaacgtaagtttgataggtaagtaagttaaaaaacttttacggacctacgtaaccgtccgtacgtaaacgggtcctattccgacctagtcctccacgtacgtacccttaccaaaccgtacgtaccgcttacgtacgtcctactaaagtcgaacgtagtcgtgacgagttagaagtaccacggtactaactttattacgttagtacgtaagtaaacgtgtttcggttagggtttacgaagttactatactaaagttgtaggtagtagggtgacctcgaactaccggtgggtaccaagggacacgtacggtacctaccgtactaccgtacngtcccgtaccacgacggcctacgttccggttccttccccgtgacccctacctaccctacaacgtcgcgtaccg

SEQ ID NO: 42897 - DNA, 676 bp, Homo sapiens
  misc_feature: GYAE6OF01DDDQZ.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgataggagaattaaaaaattttacgacagactccggtaggaagggccgtattcaccatcctaccagacgtacccttaccaaccatacgctgtatctacaaatgaacagtggtgaactagttaggaagacacggtactaaacttatttattaggtagaacgtaaagtagtttacgtttaggttacgagtctaagtactaagttggtagggtagtaggggtcggtacctacggacgtacccggtgggggaccgtaacggggaaccgtacgtcgggtaccgtacccggttcttacccgtcgaaccgtccccgtaccccgaaccgaaccgggtaccccgtagttccccgggttccccttacccccccgtaggccccttaccccctaccccgttacccgaaacggccgtcccgtacccggg

SEQ ID NO: 42898 - DNA, 606 bp, Homo sapiens
  misc_feature: GYAE6OF01A5BRG.31.14.B03.1.454.CMB.1.raw
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggcccccaggcaagggactggagtgggtggcatttatactaatttgatggagtaataaaaatttacgacagactccgtgaaggccgattcaccatctccagacgacccttccaaccatacgctgtatctaccaaatagaacatggtnacagttagaagacacggactaaacttattattgtagacgtaaagtatttcgttggttcgagcatacaatgtaggtagtagggtgctacgacaccggtggggaccagggaaccacgtcggtacctaccgtcctcccgtcaccgtccctacccgaacccgaacgggccccctaggttcccggtcccctttccccccgtggacccctaccccctcccgtaacccaacggtccgccctaacccgg

SEQ ID NO: 42899 - DNA, 618 bp, Homo sapiens
  misc_feature: GYAE6OF01EQZEE.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggcccaggcaagggctggagtgggtggctattttanactaatttgatggaagtaataaaaaattttacgacagactccggtaggaacgggccgtaattccaccattcctccagacgaccccttccaaccatacgctcgtatcctaccaaatacgaacagtggtagactagttagaagacacggactaacttaattattgtagacgtaaagtgtttcgttggttacgagtacaatcaagtggtaggtagtaggggtgactcggacctaccggtcgggacgaagggactacgtggtaccaccgttctccncgacgccctaccgaacccgacgggcccctagttcccggttcccttcccccgtggacccctaccccgtaccctaccgaacgacgtcctaacccgg

SEQ ID NO: 42900 - DNA, 576 bp, Homo sapiens
  misc_feature: GYAE6OF01BQW11.31.14.B03.1.454.CMB.1.raw
  modified_base (367)..(367): a, c, t, g, unknown or other
  misc_feature (367)..(367): n is a, c, g, or t
  modified_base (500)..(500): a, c, t, g, unknown or other
  misc_feature (500)..(500): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggaagtaataaaaaattttcgcaagactccgtgaagggccgattcaccatctccagacgacccttccaaccatacgctgtatctaccaaatgaacatggtgaanagttagaagacacggactaaacgttattattaggtgacgtaaagtattcggtttggttccgaagtactatacaatggtaggtagtaggggtgctcgaccacgtgggccaagggaacacgtgtcaccgtctccncacgccctaccgaccgaacggcccacgtccggtcccttcccccgtggcccctaccctccctacaagccgctacccg

SEQ ID NO: 42901 - DNA, 542 bp, Homo sapiens
  misc_feature: GYAE6OF01BF4YC.31.14.B03.1.454.CMB.1.raw
  modified_base (475)..(475): a, c, t, g, unknown or other
  misc_feature (475)..(475): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagtattcgttggttcgagcatcaatgtggatagggtggctcgacaccgtggggccagggaacacgtggtcaccgtctcctncgcctccaccagggcccagtccggtccttcccccgnggccctaccctccctaccaacgcgccacccg

SEQ ID NO: 42902 - DNA, 918 bp, Homo sapiens
  misc_feature: GYAE6OF01DK5C1.31.14.B03.1.454.CMB.1.raw
tcagcagtagacgtcacgaccggtgctcgatttagtgtgagtagtttgggcgtgagctgggtttcctcgttgctcttttaagaggtgtccagtgtcaggtgcactggtggaatcgtggggagcgtggtccggcgtgggggtcctgagctctcctgtgcctatgtctgcgttctagaattcactcctcaggcacttagtggcagtcggccacggtcgggtcccgaccgacggccccaaggcgaacgggactgggacgttgggtagctaagttttacaacgtaatttgagtaggtaagtaaatttaaaaacgttttcgactaacgtaccgtaccggtaggaacgggccgttacgttaccaacgtacttcccgtaccgtacggtaacctaccccttacccgtaaaccgtacgttaccggtacctttacggtaacgttccctaaccgtaaacttagaaaccgtaaggttgggtaacgacgtttaaggttacggaacggtaaccgaaccgggttacttaaaccttttaagtttaacgtttcggtaacggtaaccgttaaaggttacgtttttacggggttacggtttaccggaacgttacgtaaacgttacgtaaagggtttgggttaacgggtaaggggtttcggggtaccggttacccggttacgggtaacccgtacggggttccgggggaaccgtaaaccggggtaaacgtcccggtttacgggtaccccttaccggttacccgttaccgttaccgaacccgggtccctaaaccccggaaccccgggttaaccgggtaacccccgttaccggtttcccccgggtttaaccccccgttaccccccggttacggaacccccccgtttaccccggttaaccccgtaaccgtaaccgggtacccgtaccccgttaacccggggg

SEQ ID NO: 42903 - DNA, 611 bp, Homo sapiens
  misc_feature: GYAE6OF01A7IOB.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (367)..(367): a, c, t, g, unknown or other
  misc_feature (367)..(367): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccaggcccccaggcaagggactggagtgggtggctatttanactaatttgatggagtaataaaaaattttcgacaagactccgtggaagggccgattcaccatctccagacgacccttaccaaccatacgctgtactctaccaaatgaaacntggtagactagttagaagacacggactaaactttattattgtagacgtaaagtntttcggttggttcgaagctaatactaagtggtaggaagtagggtgcgtacgacgaccgtggggacccgagggaaccacgtcggtcctacccgttcctcctccgacgccctaccgaacccgaaccggccctatcccggttccctcccccgtcgaccctacccctcccgtaccaaccgtcgcccgtacccgg

SEQ ID NO: 42904 - DNA, 851 bp, Homo sapiens
  misc_feature: GYAE6OF01CSQM4.31.14.B03.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcactatggcatgcacgtcgggccnccacggccccaggcgaaagggctgggaggttgggtgactaattttataacgtaagttttgagtaggaagtaaattaaaaaaattttcgactaacgtactaccggtaggaacgggtaccgtaactttaccaaccctactccgttacccgaaacgtaacccggtaaccccctttacccaaaaccctaacttaaccgtacgttacgtaacttaccctaaccctaaaagtacgaaaccgtaagttacgggtacgtaacgtaaaggtttacggaaaacgtaaccgtaaaccgggtacttaaaacgtttaatttacgttaggtacggtaacggttaaaagttcgttttcgggtttaggtaccgaagtacctaattaaccgtaagttgggtaggtaacgggtacgggtcgtccggtaaccgtaacgcccgggttaggggaaccccgaaaggggtaaccgaccggttccgggtaaccctacccgggttccctacccgtaccgaaccgtacccccgtaacccggtaaaccccggaaccgggtccccttaaccggttccccggtttaccccgttcccccccgtacggtaccccctacccccgttacccgtaacccgaacgtcccgtaccccgttaaccccgggg

SEQ ID NO: 42905 - DNA, 705 bp, Homo sapiens
  misc_feature: GYAE6OF01EDTCW.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtcccnccgacggccccaggcgaagggctggagtgggtgactatttatactaatttgagtggaagtaaattaaaaaagttttcgacaacgtaccgttccggtaggaacgggcccgtaattccgaaccattcctaccgaagaccgtaccccttacccaaacctactaccgcttacgtactacctaaccaaatacgaaactagtggtagactaggttacgaagacgacggtacttaacgtttaattagttagacggtaacgtaaagttcgtttacggttggttacgagctaatacgtaaagtggtaggtaggttacggggtcgtacgtacgacgaccgggtcggggaccgtaagggaactacgtcggtaccaccgtcctaccgtcgaccgtccctaacccgaccgaaccgggtccctacgttcccggttccccttaccccccgtggacccccttaccccgtaccctaacccgaacgtcccgtcccgtaaccccggg

SEQ ID NO: 42906 - DNA, 609 bp, Homo sapiens
  misc_feature: GYAE6OF01C4O6M.31.14.B03.1.454.CMB.1.raw
  modified_base (215)..(215): a, c, t, g, unknown or other
  misc_feature (215)..(215): n is a, c, g, or t
  modified_base (384)..(384): a, c, t, g, unknown or other
  misc_feature (384)..(384): n is a, c, g, or t
  modified_base (468)..(468): a, c, t, g, unknown or other
  misc_feature (468)..(468): n is a, c, g, or t
tcagcagtagacgtcacgaccggtgctcgatttagtgtgagtagtttgggctgagctgggttttcctcgttgctctttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggctggagtgggtgcatttatacaatttgataggaagaattaaaaaattttacgacaagactaccgtaggaacgggccgaattccaccaatcctccgagacgaccccttaccaaccataacgctagtactactaccaaatcgaacagtggtnacagttagaagtacacggactaactttattatgtagacgtaaagtagtttcgttaggttcgatcatacaatgtaggagtagggngctacgacaccgtggggaccaagggaacctgtcggtcacccgttctcctacgacgtccctaccgaaccgaacgggcccctagttcccggttcccttcccccgtcgccctaccccttccctacccaacgcgcccgtaacccg

SEQ ID NO: 42907 - DNA, 849 bp, Homo sapiens
  misc_feature: GYAE6OF01DLPT5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacggccccagggcaagggactgggagtgggtggctatttatactaatttgagtaggaagtaaattaaaaaaattttacgactaacggtaacctaccggtaggaaacggggcccgtaactttaccaacctaattccgtacccgaacggaaccgtaaccccctttaccaaaaccctaagttaccgtcttagtaacttacctaacctaaaacgtacgaaactagttagggtacgtaacgtaaggtttaggaaacgtaacgtaacggtaaccttaaaacttttaacgtttaacgtttagggtacggtaaacggttaaaaggttacgttttacggggtttagggttaccgtaaggtacctaagttaccgtaaagttggtagggtaaggttaaggggtcgtaccgttaccggaaccgtaccgggttcgggggaacccgaaggggtaacctacggtaccggttacccgtaacccgttcctacccgtaccgtaccgtaccccgttacccgaaacccggtaacccgggtcccctaaccggtttccccgggtttccccctttaccccccccggtacggtaccccccttaacccccgttaccccgtaacccgaaacgggtcccgaaccccgttacccccgggg

SEQ ID NO: 42908 - DNA, 630 bp, Homo sapiens
  misc_feature: GYAE6OF01DRPUP.31.14.B03.1.454.CMB.1.raw
  modified_base (215)..(215): a, c, t, g, unknown or other
  misc_feature (215)..(215): n is a, c, g, or t
  modified_base (618)..(618): a, c, t, g, unknown or other
  misc_feature (618)..(618): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggccccaggcaagggctggagtgggtgctatttatacaatttgataggagtaaattaaaaaattttacgacagtactccggtaggaacggggccgtattcaacctatcctaccagacgaccccttaccaacctatacgctagtacttcctaccaaatcgaaacagttggtagaacgtagttagaaacgacgacggactaaactttatttattgtagacgtaaagtactttacggtttggttacgagtcaattctaagttggtaggtagttaggggtggccttacggacaccggtggggacccaaggggaactcgtaggtccaccgttctcctcacgtcctccaccgacggcccagttcccggttcctcccccgtggaccctccccgtacctaccgaacgngtccctacccgg

SEQ ID NO: 42909 - DNA, 603 bp, Homo sapiens
  misc_feature: GYAE6OF01E0S9C.31.14.B03.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (360)..(360): a, c, t, g, unknown or other
  misc_feature (360)..(360): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggctggagtgggtgctatttanactaattttgatggagaataaaaatttcgcagactcgtgaggccgattcacatctccagacgacccttccaacatacgctagtatctaccaaatgaacagtggtanacgagttgaacgactacggactaaactttattattagtacgagaaagttagtttcgttaggttaccgagactagtacaagtgtaggagttgggtgcgtacgaccnccgtggggacctaacgggaactacgttcgggtacctaaccgtccgtccacgacgtccctacccgaccgaaccgggtccctagtcccggtcccgttcccccgaggccctacccctccctacaacgcgtccgtaccccgg

SEQ ID NO: 42910 - DNA, 716 bp, Homo sapiens
  misc_feature: GYAE6OF01BT35F.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggcccccaggcaagggactgggagtgggtgctatttatactaatttgagtaggaagtaattaaaaaattttacgacaagacctccgtaggaagggccgattcaccatctccagacgtacccttaccaaccataccgtctagtactacctaccaaatcgaaactagtggtagactagttagaacgacgacgtactaaactttattattagtacgaacgtaaagtagtttcggttaggttacgagtctatacaagttggtaggtagttagggtcgacctacggtacaccgggtagggggacccgtaaggggaaccgtacggttccgggtacccgtacccgttcccgtacccgtacgaccggtcccccttacccgaaaccccggtaaccggggtcccccctaggttcccccgggttcccccttaccccccggtccgggtaccccctaaccccccgttccccgtaaacccggaaacccggtacgccccgttaacccccggg

SEQ ID NO: 42911 - DNA, 731 bp, Homo sapiens
  misc_feature: GYAE6OF01CC5KI.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactggagtgggtgctatttanactaatttgatggagaattaaaaaatttcgacagactccgtagaacggccgatcaccatctccagacgacccttacaaccatacgctagtactactaccaaatcgaaacagttggtagaacgtagttagaaacgacgaaccggtactaaactttattattgtagaacgtaaagtagtttcggtttagggttacgagtactaatactaaagttgggtaggtaaggttaggggtcgtcgttaccggaacgtacccgggtgggggaacccgtaaggggtaacctacggttacgggtacccgtacccgttccgtacccgttacgaacccggtccccttaccccgaaacccggtaacccggggtcccccgttaacgttccccggggttttccccccttaccccccccggttacgggaaccccccttacccccctaccccggtaaccccctaaacgggtacccgtaccccgttaaccccggg

SEQ ID NO: 42912 - DNA, 713 bp, Homo sapiens
  misc_feature: GYAE6OF01AYP5R.31.14.B03.1.454.CMB.1.raw
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctnaggcactatggcatggcacgtggggtcccnccgacggcccccaggacgaagggactgggaggtgggtgactatttataactatttgataggaagtaaattaaaaatttcgactagtaccgtacggtaggaacgggcctattcgacctactcctaccagaccgtaccccttaccaaacctactaccgtactacgtaactacctaaccgaaatacgaaactagtagggtataacgtagttagaacgacgacggtactaacttattacgttagtacgacgtaagttacgtttcggttaggtacgagtactatactaagttgggtaggtaggttagggtcgtaccgtaccggacgtacccgggtcggggaaccgaacgggtaacctcggttacggtacctacccgttacctcccgtacgaccgtacccctaccgaacccggtaccgggtccctacggttccccggttccccgttcccccgacggtccccctacccctcccgtaccgaaaccggtccacccgtaccggg

SEQ ID NO: 42913 - DNA, 772 bp, Homo sapiens
  misc_feature: GYAE6OF01CQ426.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccaggccccaggcaaagggctgggagtgggtgctatttatacaatttgagtaggaagtaaattaaaaaagttttacgacaagtacgttccggtaggaaacgggccgtaattccactactcctaccaagtaccgacccttaccaacctaagtacgtactagtaactacctaccaaattacgaaactagtcggtacgaacgtaagttaggaaacgaaccgtaacggtacttaaacgtttaatttagttagagtaacgtaaagtagtttacgggtttagggtacgaagtactagtacgtaaagtgggtaggtagtaggggtcgaccgttacggaaccgtaccgggttacgggggaaccgtaacggggtaaccctaccggttacgggtacccctaacccggtttccctacccgtaccgaccgtaccccgtaccccgaacccgggtaaaccgggtccccttagggttaccccgggtttaccccttcccccccggtagggaccccctaccccccggttacccttacccggaaaacggtcccggaacccgtaaccccggg

SEQ ID NO: 42914 - DNA, 675 bp, Homo sapiens
  misc_feature: GYAE6OF01DZXNU.31.14.B03.1.454.CMB.1.raw
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtgctatttatactatttgataggaagaattaaaaatttcgacagactcggtaggaaggccgtattccacctatccgtccaaggacgtacccttaccaacctactacncttagtactcctaaccaaagtcgaaacagtacggtacaacgtaggttagaaacgacaccggtactaattattagtgtagacgtaagtagtttcgggttagtacgagtactatactaagtggtaggtagtaggggtccgtacgtaccgacgtacccgggtacggggaccgaacgggacctacggtacgggtacccacccgttcctcccgtacaccgtccctacccgacccgggaaccgggtcccctaacggttcccggttaccccgttcccccgtacggccccctaaccccgttcccaacccgaacgtcgtccccggtacccgg

SEQ ID NO: 42915 - DNA, 627 bp, Homo sapiens
  misc_feature: GYAE6OF01B1M1Z.31.14.B03.1.454.CMB.1.raw
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgctatttatacaatttgatggaagaataaaaaatttacgcagactccgtggaagggccgattcaccatcctccagacgacccttccaaccatacgctgtatctaccaaatnaacatggtanactagttagaagtacgacggtactaaactttattattgtagacgaaagtacgtttcgttgttacgagtctaatcaagtgtaggtagtagggtgctacgacaccggtgggaccgaagggacacgtcggtcctaccggttcctaccctcgacgtccctacccgaaccggtaaccgggcccctaacggttcccggttccccgtttccccccgtacggcccctaaccccccgttccctaacccgaacgaccgtcccgtaacccggg

SEQ ID NO: 42916 - DNA, 665 bp, Homo sapiens
  misc_feature: GYAE6OF01BYW4X.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagcgtgggtttcctcgttagctctttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggactgggagtgggtgctagtttanactaatttgatggaagtaattaaaaagttttacgacagtacctccggtagaacgggccgtattaccgaccaacttcctccgaacgacgtacccttaccaacctatacgctagtactctaccaatgaactagtggtacgactaggttagaacgacgacggtactaacttattattagtagacgtaagtattcggttggttcgagtcgtatacgtaagtggtagggtattagggggtacgtccgtacggtaccgtacccgggtggggacccgtaacggggaccgtaacggttcggaccgtacccgttcgtacccgttagaccgtcctacccgaccggtaaaccgggccctagtcccggttccctcccccgtcggaccctaccccgtaccctaccacggtccgcctacccggg

SEQ ID NO: 42917 - DNA, 750 bp, Homo sapiens
  misc_feature: GYAE6OF01EKHQ1.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtcccnccaggccccaggcaagggactgggagtgggtgctatttanactaatttgatggaagtaataaaaaattttacgacagtactccgtgaagggccgattcaccatctccagacgacccttaccaacctatacgcttacgtatctacccaaatgaaacagttaggtacgaactaggttagaacgacgacggactaactttaattagtttagtacgtacggtaaagttacgtttcggtttggttacgagtacctaagttactaagttgggttagggtaaggttaggggtcggtccgttaccggacctacccgggtacggggggacccgaaacgggggtaaccctacgggttcgggtacccgtaaccccgtttccgtaccccgttaccgacccggtaccccgttaccccgaaaccccggtaaaccggggtccccctaacggtttcccccggtttccccgtttaccccccccgtcgggaccccccttacccccgttacccccgttacccgaaaccgggtaccgtccccgtaacccccgggg

SEQ ID NO: 42918 - DNA, 613 bp, Homo sapiens
  misc_feature: GYAE6OF01CXAPN.31.14.B03.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtgggtccggccgtggggggtccctgagactctcctgtgccatgtctgcgtctgaattcatcctcaggcactatggcatgcacgtgggtcccnccacggccccaggcgaagggactgggagtgggtgctaatttanactaatttgagtaggaagtaattaaaaaatttcgacaagtaccgtaccggtaggaacgggtccgtattaccacctatctaccagaccgtacccttaccaaccatacgctagtactctacaaatcgaacagtganacgtagtagaagtacacgataacttattagtgtagagtaagtgttcgtggtacgagtacatactaagtgtaggtagtaggtgtcgtacgacgtaccgtagggaccgaaggactacgtcgaccgtaccgtctccgtacgacgtcccacgaaccgacggtccctaggttcccgttccctccccgtcgaccctaccccactaccgaacgcgtccgtaccgg

SEQ ID NO: 42919 - DNA, 844 bp, Homo sapiens
  misc_feature: GYAE6OF01EJOZA.31.14.B03.1.454.CMB.1.raw
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggagcgtggtccggcctggggggtcctgagactctcctgtgccatgtctgcgtctgaattcatcctnaggcactatggcatgcacgtgggtccnccacggccccaggccaagggactgggagtgggtgctatttanactaatttgatggaagtaaattaaaaaattttacgacaagtacctccggtaggaacgggtccgtaatttccaaccgtactcctaccgaagtaccgtaacccctttaccgaaaccctattaaccgcttacggttaactaccttaaccaaaagtacggaaacctagtacgggtagaacgtaaggttacggaaacgacaacgggtacttaaacgttatttaagtttaggtacgtaacggtaaagtacgttttacggtttacgggttacgacggtactaacgttacgtaaacggttggttacgggtaaggtttaacgggggtacggtacccgttacgggaacccgttaccgggttacggggggaaccctaaggggggtaaaccctacggttcgggttaaccccgtaacccggttcccttaccccggtcgtaacccggtccccccgttaaacccgaaacccgggtaacccggggtcccccttaacggttcccccgggtttccccccgtttaccccccggtcgggtaccccccccttaaccccgttaccccgtaaccccgtaaaacggggtcccgtaaccccttaacccccggggg

SEQ ID NO: 42920 - DNA, 634 bp, Homo sapiens
  misc_feature: GYAE6OF01EBPJD.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactggagtgggtgctatttatacaatttgataggagtaataaaaattttacgcagactccgtagaagggccattcaccatcctccagacgacccttaccaaccatacgctgtactctaccaaatcgaacagtggagacgtagttagaagacgacggactaacttattattgtagtacgaagtacttcgttggttacgagtacagtctaagtgtaggtagtaggggtgtctacgacgtaccgtcgggaccgaagggtactacgtcggtaccgtacccgtcctccgtacgaccgtcccgtacccgaacccgaacgggtcccctacgttcccgggtcccctttaccccccggtacgccccgtacccccttaccgtacccgaaacggtcccgcccgtaccccggg

SEQ ID NO: 42921 - DNA, 742 bp, Homo sapiens
  misc_feature: GYAE6OF01AYGFU.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccncaggccccaggcaagggactggagtgggtgcatttanactaattgatggagtaattaaaaatttacgacagactccgtagaaggccgatcaccatctccagacgacccttccaaccatacgctagtactctaccaaatgaaacagtaggtagactagttagaacgacacggactaaactttattagttgtagtacgtaaagtacgtttacggtttaggttacgaagtctaagtacgtaaacgttgggtagggttaaggttaacgggggtggtacccgttaccggaaccgtaacccgggttacggggggaacccgtaagggggtaaacccgtaccggtttacggggttacccctacccggttacccttacccgttaccgaccgtaccccgttaccccgaaaccccgggtaaccggggtccccctaacggttccccggggtttccccctttacccccccggtgggtaacccccctaacccccgttccccgtaacccgaaaccggtacccggtaccccttaaccccgggg

SEQ ID NO: 42922 - DNA, 755 bp, Homo sapiens
  misc_feature: GYAE6OF01DKXM9.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactgggaggtgggtgcagtttatacaatttgataggaagtaaattaaaaaattttaccgacgtaagtacgtccgtaggaacgggccgtagtttaccaaccagtcctaccgaaggtaccgtacccttaccaacctatacgcttagtactctaccaaatacgaacagtggtagtactaagttagaacgtaccgaacggtactaaacgtttatttagttaggtagtaacgtaaaggtcttttacgggtttaggttacgagtctaatacgaagttggtagggtaagttacggggtcgtaccggttaccgaacgtacccggtacgggggtacccgtaacggggaaaccgtaccgggttacggtacccgtaacccgggttccttacccggtaccgacccggtaccccttacccggaaccccggaaaccggggtcccctaacggttccccggtttaccccttccccccggtacggtaccccctaccccccgttacccgtacccaaacggcccggtcccttaaccccggg

SEQ ID NO: 42923 - DNA, 743 bp, Homo sapiens
  misc_feature: GYAE6OF01A0Z1M.31.14.B03.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccacggccccaggcaagggactgggagtgggtgctatttanaactaatttgagtggaagtaaattaaaaattttcgactagacgtcgtaggaacgggccgtattccgactatcctaccagacgtaccccttaccaacatacgtcttagtacttacctaacctaaagtagaaacctagtcgggtacgtaacgtaaggttagaaacgtaaccgtaacggacttaaacgtttagtttaacgtttggtaagtaaccggtaaaggttaacgttttcggttagggttacgaatacgtaatacgtaaggttggtagggtaggtagggtggtccgttacggaccgtaccgggtcggggaaccgtaacgggaaacctcggttaccgggtacctacccggtccctacctccggaccgtacccctacccggaacccggaacccgggtccctaacccggttcccggttccccgtttacccccgccggacccccttaccccgtaccctaacccgacggtacccgtcccgtaaccccgggg

SEQ ID NO: 42924 - DNA, 747 bp, Homo sapiens
  misc_feature: GYAE6OF01C2CAT.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggcccaggcaagggctggagtgggtggcatttatacaatttgatggaagtaattaaaaaatttcgacaagacctccgtaggaacgggccattccaacctatcctaccagacgtaccccttaccaacctataccgctagtaactcctacctaaaatgaaacctatagggtacgacgtaaggttacgaaacgaaccgacgggtactaaacttttatttaagttggtacgaacggtaaaagtctttacgggtttagggtacgaagtcctaagttaccgaagttgggtagggtaagttaagggggtcggtccgttaccggaaccgtacccggttcgggggacccaaagggggtaaacctcggttacgggtacctacccggttccctacccgtacgaaccggtcccctacccgaacccggaacccggggtaccccctaaggtttccccgggttacccctttaccccccccgggtaggacccccctaacccccgttacccgtaccccgaaacgggtcccgaccccgtaaccccggg

SEQ ID NO: 42925 - DNA, 764 bp, Homo sapiens
  misc_feature: GYAE6OF01C0IIM.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggcccccaggcaagggctggagtgggtggcatttanacaatttgatggaagaattaaaaaatttacgacagactccgtaggaagggccgattcaccatctaccagacgacccttaccaaccatacgctagtactctaccaaatcgaaactagtaggtacgaactaggttagaaacgaccacggtactaaactttatttagttgtagaacgtaaagtgtttacgtttaggtacgagctaatacaagttggtagggtaagttacggggtcggtaccgttacggaacccgtacccgggtacggggggaaccccgtaagggggaaaccctaccggttacggggttacccgtaaccccggtttcccgttaccccgtaccggaaccgtaccccccgtaaccccgaaaccccgggaaaccgggggtacccccctaaacggtttccccccggggtttaaccccctttccccccccggtagggtacccccccttaacccccccgttacccccgttaaccccggaaaacggtcccggacccccgttaaccccggg

SEQ ID NO: 42926 - DNA, 762 bp, Homo sapiens
  misc_feature: GYAE6OF01DL9WP.31.14.B03.1.454.CMB.1.raw
  modified_base (188)..(188): a, c, t, g, unknown or other
  misc_feature (188)..(188): n is a, c, g, or t
  modified_base (259)..(259): a, c, t, g, unknown or other
  misc_feature (259)..(259): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctnaggcatatggcatgcacgtcgggtcccgccgaggcccccaggcaagggactgggagtgggtggctatttanacaatttgagtaggaagaaattaaaaaattttcgactagactccgtaggaagggccgtattccacctatcctacagaccgacccttaccaacctagtacgctgtactacctaccaaatgaaactagtggagtacgtaaggttagaacgacgacggtactaaactttagtttataggtagaacggtaaagttntttacgggtttggttacggagtcaacttacgtaaagttgggtaacggtaaggttacgggggtcggacccttaccggaaccggtacccgggttgggggaaacccgtaacgggggtaaacctaccgggtttcgggtacccgttaaccccggtttcctacccggttaaccaccccgggtaaccctacccccggaaaccgggtaacccggggacccccttaccggttccccgggtttaccccttcccccccggtacgggacccccttaacccccgttaccctaacccgaaacggtcccgccccgttaaccccggg

SEQ ID NO: 42927 - DNA, 767 bp, Homo sapiens
  misc_feature: GYAE6OF01CQ1U3.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgacacgtgggccnccgacggcccaggcaaagggctgggaggtgggtgactagtttataacgtaattgaagtaggaagtaaattaaaaaagtttcgacgtaagtaccgttcggtaggaacgggcctaactttaccgaacctactccgtaccgaacgtaccgtaaccccttaccaaacctataccgtctagtactacctaactaaatacgaaactagtacggtagtaacgtaggttacgaacgtaacgtacggtaacttaaaactttattaagtagtacgtaacgtaaagttacgttcgggttaggttacgagtactaagttactaaggtacggtagggaaggttacgggcggtacctacggaacgtcccgggtacggggaccgtaaagggtacctacggttacgggtaccctaccgggttaccctaccgaccgtacccgtccctaacccggaacccgtaaccggggtccccttaaccggttccccgggtttccccttaccccccgggacgtacccccccttacccgttacccgaacccgtaacgggtacgtcccccgtaaccggg

SEQ ID NO: 42928 - DNA, 694 bp, Homo sapiens
  misc_feature: GYAE6OF01C1B3V.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactagtggcatgcacgtcgggtccgccgacggccccaggcgaagggactgggaggtggggtgctagttttactactaagtttgagtaggaagtaaattaaaaaatttcgacagaccgtaccggtaggaacgggccgtattaccgaccactcctaccaagaccgtaccccttaccgaacctactaccgcttagtactacctaacaaagtcgaaactagtacggagactaaggttacgaaacgaccgacggtactaaagtttattagttgtagtaacgtaagttcgtttcggttaggttacgagtactatacgtaagttggtaggtaagttaggggtcgtccgtaccgaacgtccggtacggggaccgaacgggaccgtaccgtcgggtaccctccgttaccctcccgtaccaccgtaccctccgaaccgaccggccctacggttcccgtccccttccccgcgtacccctcccctaccgaccaacgtccgtaccgtcccggg

SEQ ID NO: 42929 - DNA, 742 bp, Homo sapiens
  misc_feature: GYAE6OF01CLR4K.31.14.B03.1.454.CMB.1.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcagtgcacgtcgggtccnccgaggccccagggccaaggggactgggaggtgggtggctatttanactaattgagtaggaagtaaattaaaaaatttcggacaagacgtacgtaggaagggccgtattccaacctactcctaccacgaaccgtaccctttaccaaccaattaccgacttgtactacctacctaaatacgtaacagttggtacgaactagttacggaaacgtacgaacggtacttaaactttagtttagtaggtacgtaacgtaaagttagtttccggtttagggttaccgtaaggactaagttacaaagttgggtaaggtaggtaggggtcgtaccgtacggaccgtaccgggttcggggacccgaaggggaccctaccggtaggtacccgtaccgttccctaccgttaccgaacggtccccgtacccgaccgaaacccggggtccctaacggttccccggttcccgttaccccccgtcgggtacccctaccccgttacccgtacccgaaacggtcccgtaccctaccccgggg

SEQ ID NO: 42930 - DNA, 582 bp, Homo sapiens
  misc_feature: GYAE6OF01DBICG.31.14.B03.1.454.CMB.1.raw
  modified_base (213)..(213): a, c, t, g, unknown or other
  misc_feature (213)..(213): n is a, c, g, or t
  modified_base (364)..(364): a, c, t, g, unknown or other
  misc_feature (364)..(364): n is a, c, g, or t
  modified_base (456)..(456): a, c, t, g, unknown or other
  misc_feature (456)..(456): n is a, c, g, or t
  modified_base (542)..(542): a, c, t, g, unknown or other
  misc_feature (542)..(542): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaaggggactggagtgggtggcattttagtacaatttgatggagataaaaaattttcgcagactcgtgaaggcgattcaccatctcagacgacccttccaaccatacgctgtatcctaccaaatacgaacactgggtanactaggttagaagacaccggactaaactttattattagtcgaacgtaaagtatttcggttaggttcagtcaagtcaaagtgtggagtagggngctcgacaccgtgggaccagggacacgtggtaccacgtctccgtcagccctaccacgaacgggccctagtcccgtcccttcccccnggtaccccacccgttacccaccgaacgcgtccgaacccgg

SEQ ID NO: 42931 - DNA, 586 bp, Homo sapiens
  misc_feature: GYAE6OF01CGOVK.31.14.B03.1.454.CMB.1.raw
  modified_base (499)..(499): a, c, t, g, unknown or other
  misc_feature (499)..(499): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatggcacgtgggtccgccaggcccaggcaagggctggagtgggtgctatttatacaatttgatggagtaataaaaatttcgactagactccgtgaacgggcgattcacatctacacgacgaccttaccaacatacgctgatctacaaatgaacagtggtgactagttagaagacacggactaatattatgtagacgaaagtagttcgttaggttcgagacatacgaaatgtaggagtagggtgctacgacaccggtgggccaacgggactacgtggtaccaccgttccgccgtcgacncccgtacccgtacgaaccgggtccctagtcccggttcccttccccccgtgccctaccccnccgtacccaacgcgtacccgtacccgg

SEQ ID NO: 42932 - DNA, 734 bp, Homo sapiens
  misc_feature: GYAE6OF01DFG26.31.14.B03.1.454.CMB.1.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (697)..(697): a, c, t, g, unknown or other
  misc_feature (697)..(697): n is a, c, g, or t
tcagcagtagacgtcacgaccggtgctcgatttagtgtgagtagtttgggctgagcgtggttttcgtcgttagctcttttaagaggtgtccagtgtcaggtgcacctggtggaatcgtggggagcgtggccggctgggggtcctgagactctcctgtgccatgtctgcgtctagtaattcatcctcaggcactatggcatgccacgttggggcccnccacggcccaggacaaagggtctggagtgggtgntatttanactaatttgagtaggtaagaaattaaaaaaagttttcgactacgacgttaccggtaggaacgggtccgtatttacaacctaattccaccctaggaaccgtaacccctttaccaaaaccctattaacccgatttacgtaaacttccaaccctaaaagttacgaaacctaagttcgggttaagaccgtaaacggttaggaaaacgaaccgtacccggtaataaaaccgttttaatttaaggttagttaacgaacggtaaaaggttcgtttaccgggtttaggtttaccgaggtacctaactacgtaaagtggttagggtaagtaacggggtcgtaaccgtacggaacgtaccgtacgggggaaccacgggaaacgcgttacggcctaccgtcctcgactacgcctacccgacgaaccggtccagttcccgtcccttccccgngtaccccgtccccactaccgaacgtcgccgtacccgg

SEQ ID NO: 42933 - DNA, 577 bp, Homo sapiens
  misc_feature: GYAE6OF01BJ9CX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttatacaatttgatggagaataaaaattttacgcagactcgtgaagggccgattcaccatctccagacgacccttccaaccatacgctgtatctaccaaatgaacatggtgacagttagaagacacggactaacttattattgtgacgtaaagtattcgttggttcgagcatcaatgtaggatagggtgctcgacaccgtgggccagggacacgtgtcaccgtctcctcacgccctccaaccgaacgggcccctagttcccgggttccccttcccccccgtgggcccctacccccgttaccctacccgaaacgtccgccctaaccccgg

SEQ ID NO: 42934 - DNA, 744 bp, Homo sapiens
  misc_feature: GYAE6OF01C1UGE.31.14.B03.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggagcgtggtccggcgtggggggtccctgagactctcctgtgccatgtctgcgtctgaattcatcctcaggcactagtggcatgcacgtgggtcccncaggcccagggcaagggactgggagtgggtgctattttanaactaatttgataggaagtaaattaaaaaaattttcgacaagtacgtccgtaggaacgggccgtaattccaaccatcctccaagtaccgacccttaccaaaccactacggccttagtactacctaaccaaatacgaaaacagttagggtanaacgtaagttaacgaaaggaaccgtaaccgggtactaaaacttttatttaagttacggttacggaacggtaaaagttagttttacgggtttacggtttacggatacgtaataaccgtaaagttgggtacgggtaagttaaggggtcgtaccgtacggactaacccgggtcgggggaacccaaagggggtaccacgggttgttacccgtacgtccctaccgtacacgtcccctaccgaacccgaacgggtcccctacgttcccggttccccctttccccccggagggtccccctaaccccgttccctaaacccgaaggacccgtcccgtaaccccggg

SEQ ID NO: 42935 - DNA, 917 bp, Homo sapiens
  misc_feature: GYAE6OF01EQJS0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctgggggtcctcgagactctcctcgtgcactgtctgcgtctgaattactactcctccaggcgactactggcgactgcgaccgtcgggtccggcccacggccccgacggacgaacggacgtcggtaggtgggtggtacgtattttaattaacgtaaattttggtagtagggtaaagtaaaatttaaaaaaaacttttttaaccgcgaagtaaccgttacccggtaggaaaggggaccccgtactttaccacccgaattccgttacccaacggaaccgtaaccccccttttccccaaaacccgaattaccggtaccgttcgttaaactaccttaaccccaaaaagttagtaaaccgtaagttggggttacggaactaacggtttaggaaacggaaaccaccgggtaacttaaacttttaatttagtttggacggtaacggaaaacgtttaggttttcggtttgggttaccggaacgaaccttaagttaccttaaaaggttgggttcggggtaaagttaagggggttcggggacccttaccgggaacccgtaaaccggggttccggggggaacccggaaacggggtaaaccgtcccttcggggttccctaaccccggttcccttaccccgtacgaacccggtacccccgttacccccgaaacccgggaaaccggggttcccccgtaactttaccccggggtttccccctttaacccccccccgtgggaacccctaaccccccttaccccgttaccgaaacggaacgggtccccctaaacccgggg

SEQ ID NO: 42936 - DNA, 796 bp, Homo sapiens
  misc_feature: GYAE6OF01DQXG1.31.14.B03.1.454.CMB.1.raw
  modified_base (290)..(290): a, c, t, g, unknown or other
  misc_feature (290)..(290): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtccggcgtgggggtcctgagactctcctgtgccatgtctgcgtctagaattcatcctacgaggcacttagtcggcatcgactacggtcggggtacccaccgaccggcccccgagggaccgaaaggggtacgtggggtagggttggggcgtacttaattttaanacgttaagttttagagtaaggtaagttaaaaatttaaaaaacgttttacgacgtaacgtaccgtaccggtaaggaaccgggtcccttaacttaccaacctacttaccctaccgaacggtaacccgtaccccttaccaaacctaacgttaccgcgttagttaacctacctaaccgtaaagtacgaaacgtagtaggtacacgtaggttaagaacgtacgacggtaacttaactttagttagttagagtaacgtaaagttcgtttacggtttcggtacgatctaatacgtaggttggtaggtaggtacgggtcgtacctacggaccgtaccgggtcgggggaaccaacgggtaacctcggttccggtaccctacccgttccgtacccttaccgacccgtaccccgtacccgaaccggtaacccgggacccttaggttcccccggttcccctcccccgggtcgaccccctccccgtaacctaccgaaaccggccgtacccggtacccgg

SEQ ID NO: 42937 - DNA, 842 bp, Homo sapiens
  misc_feature: GYAE6OF01DYGGS.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtcccggcctggggggtccctgagactctcctgtgccatgtctgcgtctgaattcatcctcaggcactatggcatgcacgtgggtcccnccacggcccccagggcaagggactgggaggtgggtggctatttataactaatttgattaggaagtaaattaaaaaagttttacgacaagaccgtccggtagaacgggccgtattaccaacctatcctaccgaacgaccgtacccttaccaacctatacgctacgtactactaccaaatgaaactagtaggtacgtaacgtaaggttaacggaaacgaaccgaaccgggtactaaaacgttttaatttagtttaggtaggaaccgttaaaaggttacgttttacgggtttaggttaccggtaagtactaactaccgtaaagttgggtaagggtaaggttagggggtcggtaccgtacggaacccgtacccgggtacgggggacccgaaagggggaaaccctaccgggttacggttacccgtaaccccggttacccgttcccgtaacccgtacccggtacccccttacccccggaaacccgggtaaaccccggggtacccccttaacgggtttcccccgggtttaacccccgtttccccccccggttacggggacccccccttaaccccccgtaacccccgttaaccccggaaaaccgggcccggtaaccccgttaaccccccgggg

SEQ ID NO: 42938 - DNA, 878 bp, Homo sapiens
  misc_feature: GYAE6OF01CE0LX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtggggggtccctgagactctcctgtgccatgtctgcgtctgaattcatcctcaggcactatggcatgcacgtcgggtcccgccacggccccaggcgaaaggggactgggaggtggggtggctaattttaatactaagtttgaagtaggaagtaaattaaaaaaattttacgacaacgtaccgtaccggtaggaacggggaccgtactttaccaacctactcctaccgaacgaccgtaaccccttaccaaaccacttaccgcttagtaactacctaacctaaaatacgaaactaggttacgggtagtaactaaggttagaaaacggaaccgtaaaccgggtacttaaaacttttaagtttaagtttaggtacggtaacggtaaaaggttacgttttacgggtttgggtttaccgagtacctaagttacgtaaagttgggtaagggtaaggttacgggggtcggtaccgttaccgggaaccgtaacccggggttacggggggaacccgtaaacggggggtaaaccctaaccgggttacgggttacccctaacccgggttcccttaccccgtaccgtaaccggtacccccgttaccccgaaaaccccgggtaaccggggtcccccctaacgggtttcccccgggtttcccccgttttacccccccggtaccgggtacccccctaaccccccttaccccggtaaacccgaaaccggtacccggtaccccgttaacccccgggg

SEQ ID NO: 42939 - DNA, 678 bp, Homo sapiens
  misc_feature: GYAE6OF01CAZF7.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggtactgggagtgggtgctagtttatactaatttgagtggaataattaaaaaatttgacagtactccgtgaagggcagttcacatctcagacgacccttaccaaccatacgctgtatcctacaaagtcgaacagtggtagaaccgtagttagaagctaacggactaaacttatactggtagacgtaagtactttcggtaggttcgagtactaagtactaaagtcggtaggagttagggtagcctacggacgtaccggtcggggaccgaagggacctaaggtccggtacctacccgggttctcccctacgacggtaccctacccgaaccggtaacccggggtcccctaaccgggttccccggttccccttcccccccggtaccgggtccccctaaacccccgttccccgttaacccaacggtccccggtacccgttaacccccgggg

SEQ ID NO: 42940 - DNA, 726 bp, Homo sapiens
  misc_feature: GYAE6OF01B8X88.31.14.B03.1.454.CMB.1.raw
  modified_base (265)..(265): a, c, t, g, unknown or other
  misc_feature (265)..(265): n is a, c, g, or t
  modified_base (327)..(327): a, c, t, g, unknown or other
  misc_feature (327)..(327): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgcatgtctgcgtctgaattcatcctcaggcactatggcatgcacgtcgggtcccgccacggcccccaggccgaaggggactggggaggttgggtggctatttanactaatttgatggaagaaattaaaaaattttcgacagactccgtgaagggccatcaccatcnccagacgaccccttccaaccatacgcttagtactcctacctaaatcgaaaccagtggtagaactaggttagaacgacacggtactaaacttatttattggtagacgtaaagttactttcggttagggttacgagtactatacgaagttggtaggtaaggttaggggtcggaccttcggaaccacccgggttacggggacccgaacggggtaacctaccggttcgggtacccgtacccgttacctccccgtaccgacccgtccccgttaccccgaaaccccggtaaccggggtaccccctaccggttccccgggttccccctttcccccccgggtccggaccccccgttaccccccgttaccccctaacccgaaaccggtccgtccccgtaacccccggg

SEQ ID NO: 42941 - DNA, 858 bp, Homo sapiens
  misc_feature: GYAE6OF01CFXHP.31.14.B03.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtggggggtccctgagactctcctgtgccatgtctgcgtctgaattcatcctnaggcactatggcatgcacgtcgggtcccnccgacgggccccaggacgaagggcgtgggaggtgggtggactatttataactagtttgagtaggaataaattaaaaacgtttcgacagtacgtccgtaggaacgggcctattccacctagtcctacgacgtactaccccttacaacctactacgtacttagttacctacctaacccgtaaaattcggtaaacctaggttacgggtaacgtaacgtaacggttaacggaaacgtaaccggtaccggtaacttaaacgttttagttaagttggtaacgtaacggttaaaagtttcgttttcgggtttaacgggttacgacgtacgtaacgttacgaaggttgggtaggtaacgggttggggtaccgtacccggttacgaaccggttacccggggttacgggggaaccccgtaaggggtaaccctaccgggtttaccggtaccccgttaccccgttacccgttcccgtacccggaaccgttcccccgtaaacccggaaaccccgggaccgggttacccgttacccggtttacccccggggtttcccctttaccccccccgggtaacgggtaccccccgttaaccccccgttacccgtaaccccggtaaaaccgggtcccgtaacccccggttaaccccggggg

SEQ ID NO: 42942 - DNA, 1061 bp, Homo sapiens
  misc_feature: GYAE6OF01CHU8Z.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgccacgtcggggtcccgcccgacggcccccgaagggaccgaaagggggtaccgtgggaggtggggtaggaccttaagttttaactaacgtaaagttttggaagttaggggtaaacgtaaaatttaaaaaaaaacgttttttaccggacctaaacggtaacccgttaccccgggttaagggaaaaccgggggtaccccggtaacttttaccccgaaacccctaacgttacccttaaccccggaaacggtaacccggtaacccccccttttaacccaaaaccccgtaaccttaacccggtctttaacggttaacttacccttaacccctaaaaagttacggaaaacctacggttacggggttaacgtaaccgtaaagggtttaacggaaaacggtaacccggtaaccgggtaacctttaaaaaccgtttttaaagttttagttttacgggttaacggtaaacggtaaaacgggtttacggtttttaccggggttttacgggtttaacggtaaacggtacctaaagttaaccgttaaaggttagggttaagggtaacggtttagggggtacggtaccgtttacccggaaccggtacccgggtacgggggtaacccgtaacggggggaaacctacccgggttaccggttaccctaccccggttacccgttaccccgtaacccgtaaccccggttaccccttaacccccgaaaccccggggtaacccgggttaccccccgtaacgtttaccccccggggtttacccccctttacccccccggtacccggggttaccccccttaacccccccggttacccccttacccgaaaacccggtacccggtaccccgtaaccccgggg

SEQ ID NO: 42943 - DNA, 697 bp, Homo sapiens
  misc_feature: GYAE6OF01B2XYO.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtgctatttatacaatttgatggaagtaattaaaaaagttttacgacaagactccggtagaacgggccgattcaccatctaccacgacgtacccttcaaccatacgctagtactacctaccaaatcgaacagtggtagactaggttagaaacgaccgacggtactaactttattagttcggtagacgtaaaggtactttcggttggttacgaggtctaagtacgtaaagttggtaggggtagttacggggtcggtccgtaccggaccgtacccggttcgggggaacccgaacggggtaaccgtaccggttcgggtaccctacccggttccgtccctaccgaccgtcccctacccgaacccgtaaccgggcccctacgtcccgtaccgtttcccccgttacccccgttacggtacccctacccccgttacccgacccgaagtacccggtacccg

SEQ ID NO: 42944 - DNA, 652 bp, Homo sapiens
  misc_feature: GYAE6OF01EMVRN.31.14.B03.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctcaggcactatggcatgcacgtgggtcccnccaggccccaggcaagggctgggagtgggtgctatttanactaatttgatggaagaattaaaaaattttacgacagactccgtgaagggccgattcaccatcctccagacgaccccttaccaaccactacgtctgtaatctacccaaaatgaaacagtggtgaacagtttagaaacgacaacgggacctaaatttatttaatttgtagtacgtaaagtatttccggtttgggtttacgagctaatacaattggttagggattaagggggtggtccgtacggaccaccggttcggggaccgtaacggggaacacggttggtaccgaccggtcctcctcgacgccctaccgaccgaaacgggtcccctagttcccggttcccttccccccgtaggacccctacccctaccctaaccgaacgtccgccctaaccccgg

SEQ ID NO: 42945 - DNA, 682 bp, Homo sapiens
  misc_feature: GYAE6OF01CJF12.31.14.B03.1.454.CMB.1.raw
  modified_base (218)..(218): a, c, t, g, unknown or other
  misc_feature (218)..(218): n is a, c, g, or t
  modified_base (257)..(257): a, c, t, g, unknown or other
  misc_feature (257)..(257): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactagtggcatgcacgtcgggtccnccacggccccaggcaagggctggagtgggtgctatttanactatttgataggaagtaaattaaaaaacttttcgactaagtacctccgtaggaacgggccgattccacctatcctaccaagacgtacccttaccaacctactacgctagtactcctacaaatgaaactatggagactagttagaagacacggactaactttattagttgtagacgtaaagtacgtttcggttggtacgaanctaactacgtaagttgggtaagggtaggtaaggggtcgaccgtacggaaccgtaccggtcggggaacctaaggggaacctcggttcgtaccgtacccgttcgtacctacgaccgtccctaaccgaccgtaaccgggccccttaaggttccccggttcccttacccccggtcggaccccctacccccttacccgtacccgaaacggtccgtccgtaaccccggg

SEQ ID NO: 42946 - DNA, 570 bp, Homo sapiens
  misc_feature: GYAE6OF01ETQDF.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaaggggactggagtgggtggcattttatacaatttgatggagaataaaaaattttcgcagactccgtgaagggccgattcaccatctccagacgacccttccaaccatacgctagtatctaccaaatgaacatggtgacagttagaagacacggctaaacttattattgtagacgtaaagtatttcgttggttacgagcatcaatgtaggatagggtgctcgacacgtgggaccagggaccagtggtcacgtctacctcagtccctccaaccgagggcccctagtcccggtcccttccccccgtggacccctaccctcccgtacccaacggcgcccgtacccg

SEQ ID NO: 42947 - DNA, 675 bp, Homo sapiens
  misc_feature: GYAE6OF01EZKPV.31.14.B03.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgcacgtcgggtccnccgacggcccaggcaagggctggaggtgggtgctatttanactattgataggaagtaattaaaaagtttcgacagacgtcggtaggaacgggccgtattaccacctatccgtaccagaccgtaccccttaccaacctataccgcttagtactacctaaccaaatacgaacagtggtacatagttagaacgacacggtactaaacttattagttagtacgaagtaaagttagttcggttacggttacgacgactagttacgaagttggtaggtaagttaggggtctaccgtacgaccgtaccggtcgggaccgaacgggaccacgttcggtacctaccgttcctacccgtacgaccgtccctaacccgaccggtaaccggccctacgtcccggttccccgtttcccccgcggtaccccctaccccgttacccaccggaaacgtccgacccgtacccggg

SEQ ID NO: 42948 - DNA, 659 bp, Homo sapiens
  misc_feature: GYAE6OF01D3A12.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatccctcaggcactatggcatgccacgtcgggtcccgccacggcccccaggcaagggactgggagtgggtgctatttanacaatttgataggaagtaataaaaaattttacgacagactccgtaggaacgggccgtattcacctatctccgagacacccttaccaaccatacgctgtaactctacaaatgaactagtggtacaacgtagtagaacgacacggactaaacttagttattagtagacgtaaagtgtttacggttggttacgagctaatacaagttggtaggaagttaggggtcgtcctacggaccgaccgggtggggaccgaaggggaactaccggtagtaccctaccgtcctcccgtcgaccgtcccgtacccgtaacccgacgggtcccctaagttcccggttccccttaccccccgtcggacccctacccccgttaccctacccgaaacgccgccgtaacccccggg

SEQ ID NO: 42949 - DNA, 785 bp, Homo sapiens
  misc_feature: GYAE6OF01D5MB0.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcaactggtggaatcgtgggggagcgtggtccggcctggggggtccctgagactctcctgtgccatgtctgcgtctgaattcatcctnaggcactatggcatgcacgtgggtccncaggccccaggcaagggactggagtgggngcatttanactaatttgagtaggaagtaattaaaaaagttttcgacaaggtacgttaccggtaggaaacgggccgtaatttaccgaacctaattccgtaccacgtaccgtacccctttaccaaacctactaccgtactgttaactaccgtaaccaaaagtacgaaactagttcgggacgtaaacgtaggttacgaaacgacgtaaccgggacttaaaacctttagtttacgttaggtacgtaacggtaaaacggttcgttttacgggtttacggttacgtagtacgtaacttacgtaaagttgggttaagggtaaggttacggggttacggtccgttaaccggaacccggtaccgggttacgggggacccgtaaacggggtaaccgtacggttccggtaccgttaccccggttccgtaccccttcgaaccggtcccctaaacccgacccggaacggtccccgtaacgtttcccgggtcccccttcccccggtaggccccctaacccttccccgaaaccgacggaaccgtccctaacccggg

SEQ ID NO: 42950 - DNA, 809 bp, Homo sapiens
  misc_feature: GYAE6OF01COAFH.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccacggcccccaggccaagggactgggaggtgggtgctagtttatactaatttgaagtaggaagtaaatttaaaaaacgtttttacgaacctaacggaacttacccggtaggaaacggggtacccgtaactttaccaaccctaattccgtacccaacggtaaccgtacccctttacccaaacctacgtaaccgtccttacgtacttacctacccgtaaaacttcggtaaacctaagttaggggtacgaaccgtaagtttacggaaacggaaccgtacgggtacctaaaacgttttaactttaagtttacggtacgtaaccggtaaaagtacgttttacgggtttagggttacgagtctaattacgaattacggtagggtagttaggggtaggtccgttacggactaacccggtgggggaacccaaggggtaaccctacggttcggtaccgtaacccgttccgtacccgtacgaccggtacccctacccgaaccgtaaccggggcccctaacgttccccgggttcccttccccccgtagggtacccctaaccccccgtcttaaccccgaaaggtacccgtcccgttaaccccgg

SEQ ID NO: 42951 - DNA, 707 bp, Homo sapiens
  misc_feature: GYAE6OF01AZVKV.31.14.B03.1.454.CMB.1.raw
  modified_base (219)..(219): a, c, t, g, unknown or other
  misc_feature (219)..(219): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtcccggccgtggggggtccctgagactctcctgtgccatgtctgcgtctgaattcatcctcaggcactatggcatgcacgtgggtccnccaggcccaggcaagggctggagtgggtgctatttanactaatttgataggaagtaattaaaaaagtttacgacagactccgtaggaacgggcctattcaaccatcctaccagacgacccttaccaaccataccgctagtactacctaaccaaatacgaaactagtagggtacgaacgtaggttagaaacgaacaacggacttaaactttaagttagttagtagaacgtaaagttagtttcggtttaggttacgacgtactaagtactaagtggtagggtaagtagggtcggaccttacggaaccgtacccggtggggacccgaaggggaacctacgttacggtaccaccgttcctcccgtaccacgtaccctacccgaacccgaaccgggtcccctaacggttccccgggttaccccttccccccggtacggtacccctaacccccgttaccccgtaacccgaaacggtaccgacccgtaaccccgg

SEQ ID NO: 42952 - DNA, 595 bp, Homo sapiens
  misc_feature: GYAE6OF01CSR0O.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaatttcgacagactcgtagaggccgattcaccatctccagacacccttccaaccatacgctgtatctaccaaatgaaacatggtagactagttagaagacacggacaaacttattattgtgacgaaaagtatttcgttaggttacgagtacaatacaatggtaggaagttagggtggtcctacgaactaccgtcgggggaccaaggggaacctacgtcggtaccacccggtctcctccacgccctaccgaccgaacggggccccaagttcccggtccctttcccccctggccctacccctccctaccaacgcgcctaacccg

SEQ ID NO: 42953 - DNA, 787 bp, Homo sapiens
  misc_feature: GYAE6OF01DH07U.31.14.B03.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtggggggtccctgagactctcctgtgccatgtctgcgtctgaattcatcctcaggcactatggcatgcacgtcgggtcccnccacggcccccaggcgaagggactggagtgggtgctaatttanactaatttgataggaagtaaattaaaaaatttcgacaagacgtccggtaggaagggccgtattcaccatctccgaagtaccgaccccttaccaaacctataacncttagtaactacctaaccaaatacgaaactagttcgggtagtaacgtaaggttagaaaacgacgaacgggtaccttaaactttatttagttaggtacgaaggtaaacgttagtttacggtttgggtacgaagtctaagtactaaagtgggttagggtaaggttacggggtacggtcccgttaccggaaccgtacccgggttacgggggaacccgaaaggggtaaccctaccgggttacgggttaccctaacccggttccctacccgtaccgaaccgttcccccgtacccgaaaccccggtaaccgggtcccctaaccgggtttaccccggttcccccgtttacccccccggtaccgggaccccccttacccccgttaaccccgttaacccgaaaacgggtcccgtacccccgtaaccccggg

SEQ ID NO: 42954 - DNA, 735 bp, Homo sapiens
  misc_feature: GYAE6OF01DMMPV.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtgggtccggccgtggggggtccctgagactctcctgtgccatgtctgcgtctgaattcatcctnaggcactatggcatgcacgtcgggtcccgccacgggcccccagggcgaaaggggtactgggaggttggggtggctaattttatactaatttgagtaggaagtaaattaaaaaatttacgacaagtaccgtccggtagaacgggccgtattccaccatcctaccgacgaacgtaccccttaccaacctactaccgcttagtaactactaaccaaagtcgaaactagtggtagtaacgtacggttagaaacgaacgacggtactaaactttatttagttaggtagaacgtaaagtcgtttacggttggtacggagtacaatactagttggtaggtagttagggtcgcctacggacctacgggtacgggaccgaacgggaacctacggtcggtaccgtacccgttacctcccgtacgacccgtcccgtacccgaacccggtaaccggggtcccctaacggttccccgggttccccctttaccccccggcgggtaccccccttacccccggttacccacccggaaaccggtcggtccccgtaacccggg

SEQ ID NO: 42955 - DNA, 722 bp, Homo sapiens
  misc_feature: GYAE6OF01DE8IK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccacggccccaggcaagggctgggagtgggtggctatttatactaatttgataggaagaattaaaaaattttacgacaagactccggtaggaacggccgtattcaccatcctccagacgacccttaccaaccatacgtctgtactctacaaatgaacagtgtagactagttgaagacacggtactaaactttattattagtagaacggtaaagtagtttacggtttgggttacgagtctaacttacgaagttcgggttagggtaaggttaggggtacgggtaccgttaccgggaacccgtacccgggtcggggggaacccgtaacgggggaaacctaccggttcggtacccgtaccccgttcctcccgttacgacccgttccccgaccccgtaacccggaacccggggtacccctacggtttcccgggttcccccttaccccccggtcggacccccttaacccccttaccccgtacccgaaaccggtccgtcccgtaaccccggg

SEQ ID NO: 42956 - DNA, 798 bp, Homo sapiens
  misc_feature: GYAE6OF01A8AYP.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccnccacggccccaggcgaagggactgggagtgggtggctatttatactaatttgagtaggtaagtaaattaaaaacgttttcgactaacgtacctaccggtaggaacgggcctaagttccaaccgtacttcctaccgaacggtaccgtaccccttacccaaacctacgttaccggacttacgtaactaccctaacctaaaagttacgaaactaggttcggtacgtaacgtaaggttaagaaacggtaacccgaaccgggtacttaaaaccgttttaagtttaacgtttacggtaacggtaacggttaaaaggttcgttttacgggtttacgggtttaccgaaggtaacgtaacttacgtaaaggtttcgggtagggtaaggttaggggtcgtacgtcccggaaccgtaccgggtcggggaacccgaacggggtacctaccgggtacggttaccctacccggttacctccctacgaccgtccctacccgaaccggtaccggtccctacgttcccgggtccccttccccgtacggtaccccttacccccgtacctacccgaacgtacccgtcccgtaacccggg

SEQ ID NO: 42957 - DNA, 771 bp, Homo sapiens
  misc_feature: GYAE6OF01DFFRB.31.14.B03.1.454.CMB.1.raw
  modified_base (244)..(244): a, c, t, g, unknown or other
  misc_feature (244)..(244): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggctgggagtgggnggctatttagtacaatttgatggaagtaattaaaaaattttacgacacgtactccggtaggaacggggcctattaccaccaatcctaccgagacgtaccccttaccaacctaagtaccgacttcgtaactccttaccgaaaattcggaaactagtaggtcgaactaggttacgaagaaccacgggtactaacgttatttagttagtagaacggtaaagttcgtttacggttacgggttacgtaggtctaagtaccgaaagttcgggtagggtaagttacgggggtcgacccgttacggaacccgtaaccggttcgggggggaacccaaggggtaaacccgtaacggtccgggttacctaaccccggtttccttaccccgtccgtaaccgggtccccctacccggtaaaccggaacccggggtcccccgtaagtttccccgggggttcccccttacccccccggtggaacccccctacccccgtttaccctaaccccggaaacgggtcccgaccccgttaaccccggg

SEQ ID NO: 42958 - DNA, 552 bp, Homo sapiens
  misc_feature: GYAE6OF01A48VY.31.14.B03.1.454.CMB.1.raw
  modified_base (486)..(486): a, c, t, g, unknown or other
  misc_feature (486)..(486): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaaggcaagggactggagtgggtggcatttatacaatttgatggagaataaaaaattttacgcagactccgtgaagggccgattcaccatctccagacgacccttccaaccatacgctgtatctaccaaatgaaacatggtgacagttagaagacacgggactaaactttattattgtgacgaaagtattcgtttggttcgagcatcaatgtaggatagggtgctgacacgtgggccagggacacgtggtccaccgtctcctcncgcctccaccgaggccctatccggtccttccccgtggccctacccctcctaccaacgcgctacccg

SEQ ID NO: 42959 - DNA, 988 bp, Homo sapiens
  misc_feature: GYAE6OF01DDSEW.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctagaattcactcctcgaggcactatggcagtcgctacgtcgggtccgcccgacggccccgagggaccgaaaggggtacgtggggaggtgggggtggacttaagttttaataactaagtttaggagtaaggtaaagtaaaatttaaaaaaacgttttcgaaccgtacgtaccgtaccggtaggaacggggtcctaacttaccaacctatacctaccgaacgtaacctaccccttaacccaaacctacgtaccgcttacggtaactacctaaactaaacgtagaaactaaggttcgggtaacgtaacgtacggttaacggaaacggtaaccgaacggttaaaccttaaaacgttttaagttttaaagtttacgggtaacgtaaacggtaaaagggtttcgttttacggggtttacgggttaacggaaacgttacgtaaattaacggttaaaggttgggtaagggtaagggttacgggggtaccgtacccggttaacgaaccggggttacccgggttaccggggggaacccggtaaacgggtaaccgttaacccggggttaccggttaaccccggttacccgttaccccgttaacccgggttacccgaaacccggttacccccccgggttaaaccccaaaccccgggggtttaaacccggggtaccccccgttaaacccgggtttccccccggggttttcccccctttaccccccccggggtacccggttaaaccccccccgtaaccccccggtttacccccgaaacccgggtaaacccggttaaccccgggtccccgtttaaacccccggggg

SEQ ID NO: 42960 - DNA, 756 bp, Homo sapiens
  misc_feature: GYAE6OF01BJ1MO.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccgacctggggggtccctgagactctcctgtgccatgtctgcgtctgaattcatcctcaggcactatggcatgcacgtgggtccnccaggccccaggcaagggactggagtgggtggctatttanacaatttgatggaagaattaaaaatttcgactagactccgtagaaggccgattcaccatctccagacacccttcaacatacgctgtactctaccaaatgaacagtggtagactagttagaacgacgaacggactaactttattaatttgtagtaacgtaaagttactttcggttaggttacgaagtcctaagttacaaagttgggttaggaagttagggggtcggtaccttacggaaccgtacccggttggggggaaccctaaggggggaaaccctaccggtttacggggtaccccgtaaccccggtttcccgttaccccgttacccgtaaccggtccccttaacccccggaaacccggtaaacccgggggtccccccttaaaggtttcccccggggttccccctttacccccccccgggttagggtaccccccctaaacccccccgtttaccccggtacccctaaaaccgggtaccccggtacccgttaaaccccccgggg

SEQ ID NO: 42961 - DNA, 658 bp, Homo sapiens
  misc_feature: GYAE6OF01BP3X8.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcaagggactgggagtgggtgctatttanactaatttgataggaagtaattaaaaaagttttacgactagtacctccggtaggaacgggccgtattaccaaccatcctaccaggacgtaccccttccaaccataccgctgtactcctaccaaatacgaacagtggtacgactaggttagaacgacgaacggtactaaactttagttattggtagtaacgtaaagtacgttcggttaggttacgagtacaatacaagtggtaggtagtagggtgccgtacgacgtaccggtggggaccaagggaacctacgttcggtacctacccggtcctaccgtcgaccgtccctacccgaacccgaccgggccctacggtcccggttcccttcccccgtgacccctacccctaccctaccgaacgccgtccgtacccgg

SEQ ID NO: 42962 - DNA, 563 bp, Homo sapiens
  misc_feature: GYAE6OF01AGXVR.31.14.B03.1.454.CMB.1.raw
  modified_base (252)..(252): a, c, t, g, unknown or other
  misc_feature (252)..(252): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctgggagtgggtgcatttanacaatttgatggaagaataaaaatttacgcagactccgtgaagggccattcaccatctccagacgacccttccaaccatacgctgtactctaccaaatgaacatggtagactagttgaagacacgactaactttattattagtagacgtaaagtatttcggttggttcgagctatacaagtgtaggagtagggtgctcgacaccgtgggccagggacacgtggtcaccgtctcncacgcccaccaccgaacgggccctagtccggtcccttcccccgtggaccctaccccgtccaccaacgcgcctacccg

SEQ ID NO: 42963 - DNA, 637 bp, Homo sapiens
  misc_feature: GYAE6OF01EDMF8.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (389)..(389): a, c, t, g, unknown or other
  misc_feature (389)..(389): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccnccaggcccccaggcaagggactgggagtgggtgctatttanactaatttgataggaagtaattaaaaaattttacgactaagactccggtagaacgggccgtattaccaccatcctaccagtacgacccttccaactatacgctagtactcctaccaaatagaactagtggtanacgtagttagaacgacgacgactaattattatgtagtacgtaagtatttacggttgttacgatactaatactaagtggtaggtagtagggtcgtacgtacgaccgtaccggtggggaccaagggtacacgtcggtacccgtaccgtctccctacacgtaccctaccgaaccgtacggccctacgtcccggttcccttcccccgtacggacccctacccctacctacccgaacgtcctcccgtacccgg

SEQ ID NO: 42964 - DNA, 688 bp, Homo sapiens
  misc_feature: GYAE6OF01DGASQ.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggccgtggggggtccctgagactctcctgtgccatgtctgcgtctgaattcatcctcaggcactatggcatgcacgtgggtccgccacgggcccccagggcaaggggactgggaggtgggtggctattttatacaatttgatggaagtaaattaaaaaattttacgacagacgtccggtagaacgggccgattccaccatcctaccagacgacccttaccaaccatacgctgtactctacaaatgaacatggagactagttagaagtacgacggtacaactttattagttgtagacgtaaagtcgtttacgttggtacgagtactaagtactaagttggtaggtaagttaggggtggaccttacggaaccgtaccggtaggggggaccctaagggggaaccctacggttcggttacctacccggttccttacccgtccgtaccggtcccctacccgaacccggaaccggggcccctaacggttccccgggttccctttcccccccggtagggccccctaccccttaccctacccgaaacggccgtcccgtaacccgg

SEQ ID NO: 42965 - DNA, 628 bp, Homo sapiens
  misc_feature: GYAE6OF01EYWBY.31.14.B03.1.454.CMB.1.raw
  modified_base (257)..(257): a, c, t, g, unknown or other
  misc_feature (257)..(257): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggactgggagtgggtggctattttanactaatttgatggaagaataaaaaattttacgacagactccgtgaagggccgattcacatctccagacacccttccaacatacgctgtatctacaatnaacatggtnacagttagaagacacggactaacttattattgtagtacgtaaagtacgtttcggttggttcgaagacgtatacgaaatggtaggagttaggggtggaccttcggaaccgtaccgttacggggccgtaaggggaacctacgtcgggtacctacccgtcctccctcgaccgtccctaccaaccccgaagggcccctagttccccgggttcccttccccccgtggaccccctaacccctccccgtaaccaacggtcgcctaccccgg

SEQ ID NO: 42966 - DNA, 716 bp, Homo sapiens
  misc_feature: GYAE6OF01AXKNP.31.14.B03.1.454.CMB.1.raw
  modified_base (264)..(264): a, c, t, g, unknown or other
  misc_feature (264)..(264): n is a, c, g, or t
  modified_base (336)..(336): a, c, t, g, unknown or other
  misc_feature (336)..(336): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccgggcctggggggtccctggagactctcctgtgccatgtctgcgtctgaattcatcctcaggcactatggcatggcacgtgggtcccgccacggccccagggcgaaggggactgggaggtgggtgctatttanactaatttgagtaggtaagtaattaaaaaatttcgacagtactccggtaggaacgggtccattcaccatccnccagaccgtaccctacaaccatacgctagtactctacctaatacgaactagtggtacgaacgtaggttagaacgaccaacggactaacgtttatacgttagtacggaacgtaaagttctttacgggttaggttactaacgcgtaacgttacgaaaggtttgggtaacgggtaggttacgggggtcgaccgttcggaaccggtaccgggttcggggaaccgtaagggaaccttacggtcgggtacctaacccggtccttacccgtacgtaccgtccccgtaccgtaacccgaaccgggtccccttacggtccccggttcccttaccccgccggtacccctaccccgtacctaacccggaacgtcccgtccgtaaccccggg

SEQ ID NO: 42967 - DNA, 721 bp, Homo sapiens
  misc_feature: GYAE6OF01CAH9R.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccncacggccccaggcaagggctgggagtgggtgctatttanactaatttgatggaagtaattaaaaaatttcgacagactccgtaggaacggccgattcaccatcctccagacgacccttccaaaccatacgctacgtactcctacaaatagaaacagttagggtagaactaggttagaaagacgacggactaaacttattattgtagtacgaagtacgtttcggttaggttacgagtctatacaagttggtaggagttagggtcgtaccgtacgaaccgtaccggtcggggaaccgaacggggtaaacctaccggttacggtacccgtaacccggttcctacccgtacgtacccgtccccgttaaccccgaacccggtaaaccggggtcccccttaaacggtttcccccgggttccccctttcccccccggttacgggtaccccctaaccccccgtttaccctaaacccccggtaaacggacccggtaccccggttaacccccggg

SEQ ID NO: 42968 - DNA, 693 bp, Homo sapiens
  misc_feature: GYAE6OF01DFSMT.31.14.B03.1.454.CMB.1.raw
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtctagaattcatcctcaggcactatggcatgcacgtcgggtccgccacggccccaggacgaagggactgggaggttgggtggactattttaanactaattttgagtaggaagtaaaattaaaaaatttcgacacgtacgtccggtaggaacgggcctaagttccaaccgtacttcctaccgaacgtaccgtaccccttaccaacctataccgtacttcgtactaccgtaaccaaatacgaactagtggtagactaaggtacgaagacgacggtactaacttattagtgtagacgtaaagttcgtttacggttacgtacgagtactaatacgaagttgggtaggtaaggtacggggtcgtcctacgacccggtacggtacggggaaccgaagggtaaacctcggtacggtccaccgttcctccgtccgaccgtccctaccgaaccggtaccggtccctaggttcccggttccctccccggtagacccctaccccgtacaccgaacgcgacccgtaccggg

SEQ ID NO: 42969 - DNA, 547 bp, Homo sapiens
  misc_feature: GYAE6OF01AGUTI.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagataaaaaattttacgcagactccgtgaagggccgattcaccatctccagagacccttccaaccatacgctgtatcctccaaatgaacatggtgacagttgaagacacggcaaacttattattgtgcgaaagattcgttggttcgagcatcaatgtggatagggtgctcgacaccgtgggccagggaacacgtggtcaccgtctcctcacgcctcccaccacgggccccatccggtccttccccctggccctacccctccctacccaacgagcctacccg

SEQ ID NO: 42970 - DNA, 1011 bp, Homo sapiens
  misc_feature: GYAE6OF01D0M66.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtctgaatttcatcctcaggcactatggcatgcacgtcgggtcccgccgacggccccaggcgaagggactgggaggtggggtgactatttataactaatttgagtaggaagtaaaattaaaaaaagttttacgactaagtaaccgtcccggtaggaaacggggtcccgtaatttacccgaacctaacgttccgtacccgaacgtaacccggtaacccccttttaacccgaaaaccctaaacgttacccgggtacctttacggttaaccttacccttaaacctaaaaacgttacggaaaaccgtaaggtttaggggttaaccggtaaaccgtaaggtttaacgggaaaacggtaaccggaaaccgggtaaccttaaaacgtttttaaagttttaaggtttacgggttaacgggaaccggttaaaaaggtttacggttttaccggggttttagggtttacccggaaacggtacctaaacgttaccgttaaaaggtttggggtaaggggttaaacgggtttaacggggggttccggttacccggttaccgggtaaaaccccggtccggggtttaaccgggggggaaccccgtaaaacggggggtaaccctaaccgggttaccgggttacccgtaacccggtttcccgtacccgttacccgaaccggttccccctaccccgggtaaaacccggtaacccgggggtcccccttaaccgggtttcccccgggtttccccccgtttaccccccccgggaacgggttacccccccttaaaccccccggttacccccgttaaaccccggaaaccggttacccggtacccccgttaacccccgggggg

SEQ ID NO: 42971 - DNA, 929 bp, Homo sapiens
  misc_feature: GYAE6OF01EO1EN.31.14.B03.1.454.CMB.1.raw
tcagcagtagacgtcacgaccggtgctcgatttagtgtgagtagtttgggctgagcggtggtttcgcgtaggctctttaagaggtgtccagtgtcaggtgcacctggtggaatcgtgggggaggcgtggtccggccgtggggggtccctgagactctcctgtgccatgtctgcgtctgaattcatcctcaggcactagtggcatggctacgtcggggtcccgaccgacggccccagggacgaaaggggtacctggggaggttggggtggctaattttataactaagttttgaagttagggaaataaaatttaaaaaagttttcgacaacgtacgtccggtagaacgggtcctattccacctatcctaccagaccgtacccttccaaacctataccgtcttacgtacttacctaccaaaagttacgaaactagtgggtacgtacgtaaggttacggaaacgtacgtaacccggtattaaactttatttaagttacggtacggtaacggtaaagtttacggtttaccggtttagggtttacgaacgtacctaagtttacgaaaggtttcgggtaagggttaacggttagggggtttaccgaccgggtttaccgaaacccgggtacccggttaaggggggtcccggaaaacggggtaaccgtaaccggtttccggggtaacccctaccccgggtttaccttacccccggtaccgtaacccgggtaacccccctttaaaccccggaaaaccccggggttaaacccccgggggtccccttaacccggggttttccccccgggtttaccccccgtttttaccccccccccgggaacggggtttaccccccccccttaacccccccggtaacccccgggtttaaaacccggttaacccccggtacccgggaacccccggttttaaaccccccgggg

SEQ ID NO: 42972 - DNA, 826 bp, Homo sapiens
  misc_feature: GYAE6OF01BW4G6.31.14.B03.1.454.CMB.1.raw
  modified_base (66)..(66): a, c, t, g, unknown or other
  misc_feature (66)..(66): n is a, c, g, or t
  modified_base (100)..(100): a, c, t, g, unknown or other
  misc_feature (100)..(100): n is a, c, g, or t
tcagcagtagacgtcacgaccggtgctcgatttagtgtgagtagtttgggctgagcgtggtttccncgttgctcttttaagaggtgtccagtgtcaggtnacaccgtggtggaatcgtggggagcgtggtccggcgtgggggtccctagagactctctgtcgccatgtctgcgtctagtaacttcactcctacgaaggcctaacgttagtcggcctagttcggacctacggtcgggtcccaccgaaccggccccgtagggacccgtaaaggggaccgtggggtaacggttcgggggtagtacctttaaagttttaactaaacgtttaaagttttggaaggttaaggttaaaaggttaaaaacttttaaaaaacgtttccggaacctaacgtaccgttacggtaacggaaccgggtacctactttaacccaactacttaccgtaccgacggtaaccttaccccttaaaccgaaccgtagtaaccgtaccttagttaccctacgtaaccgtaaagttacaaaccgtggttcggtaacgtacgtaaggttacgaactaaccggacgtaactaacgtttatgtacgtacgtaacgtaagttacgtttggtacgtagactacgtatacgtaggtcgtaggtgtaacggggtctaccgtacgaccgtacgggtaaccgggtaccaacgggttacctagggttaccggtccctaacgtccgttacgacctaccggcccttacccggaaacgtcccggtacctacttccccggtcccttcccccggaggttacccctacccccctagtacccaaacggtcgtaccccgtacggg

SEQ ID NO: 42973 - DNA, 632 bp, Homo sapiens
  misc_feature: GYAE6OF01BR2UJ.31.14.B03.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (538)..(538): a, c, t, g, unknown or other
  misc_feature (538)..(538): n is a, c, g, or t
  modified_base (547)..(547): a, c, t, g, unknown or other
  misc_feature (547)..(547): n is a, c, g, or t
  modified_base (591)..(591): a, c, t, g, unknown or other
  misc_feature (591)..(591): n is a, c, g, or t
tcagcagtagacgtcacgaccggtgctcgatttagtgtgagtagtttgggctgagcgtggtttcgcgtagctctttaagaggtgtccagtgtcaggtgcacctggtggaatcgtgggggaggcgtggtccggccgtggggggtccctgagactctcctgtgccatgtctgcgtctgaattcatcctgaggcactanggcatgcacgtgggcccgccacggccccaggctaagggctggaggtgggtggctatttanactaatttgataggaagtaattaaaaatttcgacagactcgtagaggcgatcactatcncgagacacccttacaaccataccgctgtactctaccaatgaacngtaggnaacagtanaagtacacgtactaatttattaagtgtacgaacgtaagtagtttacggttaggttgagtactaagtactaaggtgtacggtagtaggggtcggtacctcggaaccgtaccgggtcggggaccgaagggtaaccgtcgtacgggtcctacccgttcctaccgtacncgtaccccnccgtaaaccgaccggtcccgtagttcccggttccccttccccgnggacccctacccgtaccctaccgaaacgcgcccgtacccgg

SEQ ID NO: 42974 - DNA, 958 bp, Homo sapiens
  misc_feature: GYAE6OF01C5ZD8.31.14.B03.1.454.CMB.1.raw
  modified_base (272)..(272): a, c, t, g, unknown or other
  misc_feature (272)..(272): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtcctgagctctcctgtgccatgtctgcgtctgaattcactcctcaggcactagtggcatgctacgtcgggcccgccgacggccccagggaccgaaaggggtcgtgggaggtgggtgactagttttanactaagtttgagtaggtaaagtaaaattaaaaaagttttaccgacgtaacgtacgtaccggtaggaaacgggtccgtaactttacccgaacctaacttccgtaacccgtaacggtaacccgttaacccctttacccgaaaaccctaacgtttacccggtacgtttacgttaaacgttaccctaaaaccgtaaaacgtaacggtaaacttaacggttacgggtaacggtaaaccgtttaaagggttaaccgaaaacggtaacccggtaaccgggttaaactttaaaaccgtttttaaagtttaacggttacgggttaacggtaaaccggttaaaggtttacggttttaccgggtttagggtttaaccggaagtaaccgttaacgttaaacggttaaggttacgggttaagggttaagggttaccggggggtttacggtaacccggttaccccggttaacgggtacccggggttcgggggaaacccgtaacgggggtacccttaaacggggtttccgggtaaccccgttacccggttaaccctttcccgtaacccgtaccccgaccgttaaccccccgaacggtaacccgggcccgttacgttccccggttacccccgttcccccggaccggtaccccctccccgttaacccgaaccccgggaacgtacccgtacccgttaccccggg

SEQ ID NO: 42975 - DNA, 832 bp, Homo sapiens
  misc_feature: GYAE6OF01B9BIF.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggccnccaggcccaggcagggactgggagtgggtgcagtttatactaagtttgagtaggaagtaaattaaaaaaagttttcgactaacgtaccgtaccggtaggaacgggtaccgtaactttccgaacctacgttacctacccgaacggtaaccgtaccccctttaacccaaaccctaacgttaaccggacctttacgttaacttaccctaacctaaaacgttacggaaacctaaggttacggggttacgaaacgttacgggttaacgaaaacggtaaccgaacggttacttaaaacctttagtttaacgtttaggtacggtacggtaaaagttagttttaccgggttagggtttacggaacgtactaacgttaacgtaaaggttgggtagggtaaaggttacggggtcggtaccgttaccgggaacgtaccgggtaccgggggtaaccggaacggggtaaacctacgggttaccggtaccggtaccgttacccgtaccgtaccgaccggtaccctacccgaaaccggtaaacccgggtcccctaacggttccccggttccccgtccccccgtaaggccccttacccccgtacctacggaacccgacggccgtaaccccggg

SEQ ID NO: 42976 - DNA, 608 bp, Homo sapiens
  misc_feature: GYAE6OF01BPN9E.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgctatttanacaatttgataggaagtaattaaaaaatttacgacagactaccgtagaaggccgattccaccatctaccagacgacccttccaaccatacgctagtactctaccaaatgaacagtggtagaactagttagaagacgacggactaaacttattatgtagaacgtaaagtattcggtttaggtacgagtactaatacaagtgtaggagtagggtcgctacgacgaccgtggggaccaagggaacncgtggacctaccgtctccncacgccctaccgaacccgacggtccctagtcccggtcccttcccccgacggacccctacccccttacccgtaccgaacgcgccctaacccgg

SEQ ID NO: 42977 - DNA, 598 bp, Homo sapiens
  misc_feature: GYAE6OF01AKWC4.31.14.B03.1.454.CMB.1.raw
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (558)..(558): a, c, t, g, unknown or other
  misc_feature (558)..(558): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggctggagtgggtgcatttanacaatttgatggagaattaaaaatttacgcagacctcgtgaagggccgattcaccatcctccagacgtacccttccaaccatacgctgtatctaccaaatgaacatggtnactagttagaagacacggactaacttattattgtagacgaaagtgtttcgttggttcgagctaatcaagtgtaggagtagggtcgtcgtcgaccacggtcggggccaaggggaacctacgtcggtccaccgttctccctccgcgaccctcccgaacccgaacgggtcccctacgtcccggttcccctttcccccgngacccctaccccgttccctacccaacggccgcctacccgg

SEQ ID NO: 42978 - DNA, 828 bp, Homo sapiens
  misc_feature: GYAE6OF01BNSI6.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccnccgacggcccccgaggcgaaggggactgggaggtgggtgctagtttatactaatttgattggaacgtaaattaaaaaacttttcggacaacgtacgtccggtacggaaacgggccgtaatttccgaaccgtattaccgtaccgaagtaccgtaccccttaccaacctatacgtctagtactcctaccaaatacgaaacctagttacggtagaaccgtaggttaagaacgtaccgaaccgggtactaaactttattagtttacgtacggtaacggtaaaggttacgtttcggttagggtttaccgaggtactaacgtacgtaagttcgggtagggtaaggttacgggggtcggtacctaccgggtaaccggtacccgggttaggggggaacccgtaaacgggggaaacctaccggggttacggttacccgtaccccggtttccgttacccccttaccgaccggttacccctaccccgtaaaccccggtaacccgggggtaccccctaacggttcccccgggtttcccccgtttaccccccccggttgggaccccccttaacccccgtttccccaaccccggtaaacgaccgggtaccccgttaaccccggg

SEQ ID NO: 42979 - DNA, 777 bp, Homo sapiens
  misc_feature: GYAE6OF01CANB4.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggaggcgtggtccggcctggggggtccctgagactctcctgtgccatgtctgcgtctgaattcatcctcaggcactatggcatgcacgtgggtcccnccacggccccaggcaaggggactgggaggtggggtggctaattttagtaactaagttttagagttaggaaagttaaattaaaaaaagttttaccgactaacgtacgtaccggtaggaacgggtccgtattaccacctatcctaccgacgaccgtaccccttaccaacctacgtaccgcttacgtactacctacctaaatacgtaaaccgagttacggtagtaccgtaaggttaggaaacgtaccgacggtaacttaactttaagttaattggtacgaacgtaaaggttacgttttcggttagggttaccagtaccgtaataccgtaaatgggttacggtaaggtaaggggttcgtccgtaaccggaccggtaccggtacgggggaccgtaacgggtaaccgtaaccgttcggtaccgtaccccgttccttaccgtccgaacccgtcccttacccgaacccggtacccggtccctaaccggttccccggttccccgttcccccggtacgtaccccgtaccccccgttacccgtacccgaaacgtccggtcccctaacccgggg

SEQ ID NO: 42980 - DNA, 731 bp, Homo sapiens
  misc_feature: GYAE6OF01B73R5.31.14.B03.1.454.CMB.1.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (721)..(721): a, c, t, g, unknown or other
  misc_feature (721)..(721): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccgggccgtggggggtccctgagactctcctgtgccatgtctgcgtctgaattcatcctcaggcactatggcatgcacgtggggtcccnccacggccccaggacgtaaggggactgggaggttgggnggctaatttataacgtaagttttgagtaggaagtaaagttaaaaaattttaccggactaagtaaccgttaccgggtaggaaacggggtcctaactttaccaacctaacttccgtaccgaacgtaccgtaaccccctttaccaaacctaactacgaccttacgtaactacctaaccaaaagttacgtaaacctagtacggtagaccgtaagttagaaacgacgacggtaactaaacgtttaagttagttagtacgaacgtaaaggttattacgggtttacggtagtacgactagtaactaagtggtaggtaagttagggtgtacgtacgactaccgggtagggaccgtaacgggaaccgcgttaccggtaaccgcccgttacgtcctaccgaccgcctaccgtaccgaaccggccctaacgtcccggttacccttcccgcgtaccctaccctcctaacacgtcncctaacccgg

SEQ ID NO: 42981 - DNA, 726 bp, Homo sapiens
  misc_feature: GYAE6OF01DC197.31.14.B03.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctgggggggtccctgagactctcctgtgccatgtctgcgtctgaattcatcctnaggcactatggcatgcactgggtccnccaggccccaggcaagggctggagtgggtggcatttanacaatttgataggagaattaaaaaattttacgcagactcgtagaagggccgattcaccatcctcagacgacccttcaaccatacnctagtactctacaaatgaacntaggtgacgagttaggaagacacggtactaaactttatttattgtgaccgtaaaagtactttcgggtttaggttaccgaggtactattaacgaattgggtagggtacttaagggggtcgacgttacggaacctaccgggttacggggaaccgtaacggggaaactaccggttacgggtacctaaccccggttccttcccgtacgtacccgtaccccggttaccccaaccccgggtaaaccgggtacccccgtaaggtttcccccgggttttcccccgttcccccccccggtaacgggtacccccctaaaccccccgttccccgttaaccccgaaaaccgggacccggtccccgttaaaccccccgggg

SEQ ID NO: 42982 - DNA, 625 bp, Homo sapiens
  misc_feature: GYAE6OF01EY2OW.31.14.B03.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (584)..(584): a, c, t, g, unknown or other
  misc_feature (584)..(584): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccaggccccaggcgaaggggactgggagtgggtggctatttanactaatttgatggagtaattaaaaaacttttacgacagactccggtaggaagggccgtattccaccactctaccagacgacccttaccaaccatacgctgtactctaccaaatcgaacagtggtagactagttagaaagacaacggactaaactttattatttggtagtacgaaagtagtttcggttggtttacgagtcatcaagttggtaggtaagtacggggtgctacgaccgtacggtcggggaccaggggaactcgtggtccaccgtctcccgatccgccctaccgaccgaacgggcccctaggtcccggtcccttcccccnggtacccctaccccgtcccaaccgagtccgccgtaacccgg

SEQ ID NO: 42983 - DNA, 700 bp, Homo sapiens
  misc_feature: GYAE6OF01B9ELF.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggccncaggcccaggcaagggctggagtcgggtgactatttanactaatttgatggaagtaataaaaatttcgactagactccgagaaggcgatcacatctccagacgacccttaccaaccgatacgctagtactacctaccaaaatcgtaaacagttacgggtagaaccgtaggttacgaaacggaactaaccgggtactaaaaccttttattaagttacggtacggtaacgtaaaggtaacgtttcggtttagggttacgagtactatacctaaagtggtaggaagttaggggtcggaccgtacgactaccggtggggacccaaggggaactaccggttcggtacctaacccggttcctcccgtaccgacgtaccccgtacccgaaaccgaccggggtacccctacggttcccgggttcccctttccccccgtacggtaccccctacccccgttacccgtacccaaacggtccgtcccgtaaccccggg

SEQ ID NO: 42984 - DNA, 618 bp, Homo sapiens
  misc_feature: GYAE6OF01E1JXH.31.14.B03.1.454.CMB.1.raw
  modified_base (252)..(252): a, c, t, g, unknown or other
  misc_feature (252)..(252): n is a, c, g, or t
  modified_base (420)..(420): a, c, t, g, unknown or other
  misc_feature (420)..(420): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaatttcgcagactcgtgaggccgattcaccatctccagacgacccttaccaaccatacgctgtactctaccaaatcgaacagtggtgactagttgaagacgacggactaacttattattgtagacgaaagtatttcggttggttacganacatctaagtgtaggtagtagggtggcctcgacctaccggtcgggaccgtaagggaactcgtacggtaccacccgtcctacctacgacgccctacccgaccgtaaaccggggcccctaaggtccccggttccctttccccccgtagggtccccctacccccgttaccctaaacccgaacggtaccgcccgtaccccgg

SEQ ID NO: 42985 - DNA, 796 bp, Homo sapiens
  misc_feature: GYAE6OF01CVGRY.31.14.B03.1.454.CMB.1.raw
  modified_base (189)..(189): a, c, t, g, unknown or other
  misc_feature (189)..(189): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtcctgagactctcctgtgccatgtctgcgtctgaattcatcctnaggcactagtggcatgcacggtcgggtccgaccacgggccccagggacgaaagggctgggaggtgggtgactatttactactaagttagtagtaggtaagtaaattaaaaactttacgacgtaacgtaccgtaccggtaggaacgggtaccgtacttaccacctactccgtaccgaacgaacccgttttttttaccccacctaacctaactaccgtacttacgtacttacctaactaaatacgtaactagtaggtacaacgtaggtacgaacgtaacgtacgtacttaaactttagttacgtagtagtaacgtaagttacgtttacggttaggtacgacgtactatacgtaagttggtaggtaggtacgggtcggtaccgtaccggacggtaccgggtacggggaaccgtaacgggtaaccgtacggttaccggtacccgttacccgttacccgttaccgtacccgtacccgtaccccgtacccggaaccccggtaacccgggtacccccgttacccgggtttccccggttcccccgttacccccggtaccgtaccccctacccccgttaccgtaccccgaaacggtccccggtacccgtacccggg

SEQ ID NO: 42986 - DNA, 748 bp, Homo sapiens
  misc_feature: GYAE6OF01BOJSS.31.14.B03.1.454.CMB.1.raw
  modified_base (254)..(254): a, c, t, g, unknown or other
  misc_feature (254)..(254): n is a, c, g, or t
  modified_base (326)..(326): a, c, t, g, unknown or other
  misc_feature (326)..(326): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccaggccccaggcaagggactggagtggtgctatttanactaatttgataggaagtaataaaaaattttacgactaagacctccgtaggaacgggccgattccaccatcnccagacgacccttacaaccatacgctgtactctaccaaatgaactatggtagactagtgaagacacggtactaacttattagttagtagacgtaaagtatttacggtttggttaccgagtactacgttaacaagttagggtagggtagttaggggtcggtaccgttacggacccgtaccgggtcgggggaacccgaaggggtaaccctacgggttacgggtacccgtaacccggttcccgttaccccgtaccgacccggttaccccgttacccccggaaaccccgggaacccgggtccccgttaacccggtttcccccgggtttccccccgtttaacccccccggtccggtaaccccccgtaccccccgtttaccccgtaaaccccgaaaccgggtacccgtaccccggttaacccccgggg

SEQ ID NO: 42987 - DNA, 599 bp, Homo sapiens
  misc_feature: GYAE6OF01ALTXA.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgctattttanactaatttgatggagtaattaaaaaattttacgacagactccgtagaagggccgattcaccatctccagacgacccttaccaaccataccgctgtactctaccaaatcgaaacagtggtagacagttagaagacacggactaaactttattattgtagacgtaaagtatttcgttggttacgagtctatcaagtggtaggtagtagggtgctcggacaccggtggggaccaaggggaactacgtggacctaccgtcctcctcacgccctaccgaccgaacgggccctagttccggtcccttcccccgtggccctaccccgtccctaccgaacgccgcctacccgg

SEQ ID NO: 42988 - DNA, 764 bp, Homo sapiens
  misc_feature: GYAE6OF01C8JOA.31.14.B03.1.454.CMB.1.raw
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggccgccgacggccccaggcaagggactgggagtgggtgactatttanaactatttagagtagtaaggtaattaaaaaactttcgacaagtacgtaccggtaggacggaccgtattaccaacctactcctaccacgtaaccgacccctttaccaaccgactacgacttacgtaacttaccctacaaatacgaaactagtagggtacaacgtaaggttagaaacgaaccgtacggtaactaaacgtttatttaacgttacggtacggaacggtaaaagttacgtttaccgggtttagggttacgtaacgtactaacgttataaaggttgggtaagggtacggttaggggtcgtaccgtaccggaaccgtaccgggtacggggacccaagggaaccttcgggtaccggtacctacccgttacctcccgtcgaccgtacccgtaccccaacggaacccgggtccctaaccggttccccgttaccccccgttacccgtcccggtaccctaaccccccgttacctacccggaaccggtaccgtccccggttaaccccggg

SEQ ID NO: 42989 - DNA, 721 bp, Homo sapiens
  misc_feature: GYAE6OF01C1HVK.31.14.B03.1.454.CMB.1.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
  modified_base (629)..(629): a, c, t, g, unknown or other
  misc_feature (629)..(629): n is a, c, g, or t
  modified_base (676)..(676): a, c, t, g, unknown or other
  misc_feature (676)..(676): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccncacggcccaggcgaagggactggaggtgggtgctatttanactaatttgagtaggaagtaaatttaaaaaacgtttcgacgtaacggtaaccgttccggtaagggaacgggtaccgtaacgtttaccaaccgtaatccgtaccaacgtaaccgtacccctttaccaaacctacgtaccgtcttagtaactacctaaacctaaagtacgaaaccgtaggtacgggtacgaacgtaaggttaacggaaacgtaaccgtaacggtactttaaacgtttagtttaacgtggtaacgacggtaaacgttcgtttacggttggtaccgagtacctagtaactaagttcggtaggtaggtagggtgaccgtacgacgaccggtagggaccgaacggaccacggtacgtccgtacgtcncctacgacgtcccacccgaccgaacgggtccctagtcccggttcccnccccgtcgaccctacccgtacccacgtaacggctaccgtaccggg

SEQ ID NO: 42990 - DNA, 605 bp, Homo sapiens
  misc_feature: GYAE6OF01BMTCK.31.14.B03.1.454.CMB.1.raw
  modified_base (253)..(253): a, c, t, g, unknown or other
  misc_feature (253)..(253): n is a, c, g, or t
  modified_base (360)..(360): a, c, t, g, unknown or other
  misc_feature (360)..(360): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaaattttacgcagactccgtgaagggccgatcaccatctccagacgacccttcaaccatacgctgtatctaccaaatgaacatggtnactagtacgaagacacggactaacttatattgtagacgaaagtattcgttggttacgagtacagtacaagtgtaggagtagggtggactcgactaccgtcggggaccaagggaactacgtcggtacctacccgttctaccttacgacgtccctacccgacccgaacgggccctaacgtcccggttccccttccccccgtcgggtccctacccccttccctaccccaaggccgtcccgtaacccgg

SEQ ID NO: 42991 - DNA, 603 bp, Homo sapiens
  misc_feature: GYAE6OF01D21F0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccaggcaagggactggagtgggtggcatttatacaatttgataggagtaattaaaaaattttacgacagactccggtagaacggccgattcaccatcctccagacaccctaccaaccatacgctgtactctacaaatcgaactagtggtgactagttagaacgacacggtactaactttattattagtagacgtaaagtgttcgttggttcgatcatactaagtgtaggagtagggtgccgtcggacaccgtggggaccaaggggaactacgtggtaccaccgttcctacctcgaccgccctcccgaaccgaaccgggcccctagtcccggttcccttcccccgtggcccctacccctacccgaccaacgcgcctacccgg

SEQ ID NO: 42992 - DNA, 714 bp, Homo sapiens
  misc_feature: GYAE6OF01DLN07.31.14.B03.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccacggccccaggcgaagggactgggagtgggtgctatttanacaatttgatggaagtaaattaaaaaattttcgactaagtacgtaccggtaggaacgggccgtaatttccaacctaattccgtaccgagtaaccgtacccctttaccaaccctaataccgctgtaacttacctaccaaaattcgaaactagtggtagaactaagttagaaacgaccgacggactaaacgtttattattacgtaggacgtaaaagtcgttttacggttggtacgaagtcaagttacaagttggtgggtaacgttacggggtggtacctccggtaaccgaccgggttacgggggacctaaggggaaacctacgttggtaccacccggttcctaccgtacaccgtccctccgaaaccgtacggggtcccctaagttcccggttccccttaccccccggtgacccctaccccttaccccgtaaccgtaaccggaccgtcccgtaacccggg

SEQ ID NO: 42993 - DNA, 776 bp, Homo sapiens
  misc_feature: GYAE6OF01DCTJR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcggtggtccggccgtggggggtccctgagactctcctgtgccatgtctgcgtctgaattcatcctcaggcactatggcatgcacgtcgggtacccgccacggcccaggcaagggactgggagtggggtgactatttataactaagtttgagtaggaagtaaattaaaaaattttacgactaagtacgtaccggtaggaacggggcctaattaccacctattacctacccgaagtaccgtaaccccttaccaaaccactaccgctacgtaactcctaacctaaaatacgaactagtacggagtaaccgtaggttaacgaaacggacgtaaacggtactaaaactttgtttaagttggtaacgtacggtaaaagttcgttttacggtaggttacggacgtactaagtacgtaagtggtagggtaagtcgggtaggtcctacggtacaccggtcggggaccgtaacgggaactacggtcgtaccgacccttcgtacccctacgaaccgtccccgttaacccaacccggtaaacccgggccccgttaccggttaccccgggtttcccccgttacccccccggtacggtaccccccgttaacccccgttaccccaacccgggtaaacctaaccggtcccccggttaaaccccgggg

SEQ ID NO: 42994 - DNA, 782 bp, Homo sapiens
  misc_feature: GYAE6OF01D0J2S.31.14.B03.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatcgcacgtcgggtccnccacggcccaggcgaagggctggagtgggtgactagtttatattaagtttgagtaggtaagtaaattaaaaactttcgacagtactccgtaggaacggccgtattaccgacctactcctccgaagtacccgtacccttaccgaaacctactaccgtcttacgtaactaccgtaactaaagtacgaaacgtagtaggtacgtaacgtaacggttaagaaacgtaacgacggtaacttaaactttattaagttcggtaacgaacggttaaagttacggtttccgggtttaggttacgtaacgtacgtaacgttacgtaaagttggggtaacggtaaggttaaggggtccggttactaacccgggtacgtaacccggggtacgggaacccgtaaacggggtaacctacgggtaccgggtacccttaccgttaccgttcccgtaaccgaccgtaccccgtacccgaaccggtaaccggtccccgtaacggtttccccggtacccgttccccccggtacgacccccttaaccccgttaccaaccccgaagtcccgcccgttaacccggg

SEQ ID NO: 42995 - DNA, 727 bp, Homo sapiens
  misc_feature: GYAE6OF01E2F85.31.14.B03.1.454.CMB.1.raw
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtcccggccgtggggggtccctgagactctcctgtgccatgtctgcgtctgaattcatcctcaggctactatggcatcgcacgtcgggtcccgccgacggccccgaggcgaagggctgggagtgggtgctatttanactaattgataggaagtaaattaaaaatttcgacacgtaccgtaccggtaggaacgggccgtattaccgaacctactcctaccgacgaaccgtaccccttaccaacctataccgtactagtactcctaacaaatacgaatagtaggacagtagtagaacgaacgacgtactaacttattagttagtacgtaacgtaagttgtttacgggttacggtacgtagtactaagtacgtaaggtagggttagggtaggttacggggtcggtaccgtaccggaaccgtaccgggtacggggaccgaacgggtaaccgtaccggttacggtacccgtaccgttccctacccgtaccgtaaccgtcccctaccgaacccggtaccgggtccctaggttcccccggttacccgttccccccggacgtaccccctaaccccgtacccaccgaaccggtccgccccgtaccggg

SEQ ID NO: 42996 - DNA, 596 bp, Homo sapiens
  misc_feature: GYAE6OF01BFVSB.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccaggcaagggactggagtgggtgctatttanactaatttgatggagtaataaaaattttcgcagactccgtgaagggccattcaccatctccagacgacccttccaaccatacgctagtatctaccaaatgaacatggtagactagttagaagacacggactaacttattattgtagacgtaaagtgttcgttaggttcgagctaatacaagtgtaggtagtgggtgtcctcgactaccggtgggccaagggacctagtcggtctaccgtctccctcgacgtccctacccaaccggacggcccctagttcccgggtcccttcccccgtgggtcccctaccccgttcccaccgaaccgtcgccctaccccggg

SEQ ID NO: 42997 - DNA, 935 bp, Homo sapiens
  misc_feature: GYAE6OF01EVFK0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtcctgagactctcctgtgccatgtctgcgtctgaattcatcctcaggctatatggcatgcacgtcgggtcccaccgacggccccgaggtacgaaacggggtacgtgggaagggttgggtacggacttaagttttaactaacgttaagttttaggaagtaagggtaaaacgtaaaaattttaaaaaaacgttttcgaaccgtaacgtaccgtaccggtaagggaacgggtaccgtattacccgaaccgtactacctaccgaacgtaacccgtacccttacccaaactacgtacgtacttcgttactacgtaaccaaatacgtaactaggtaggtaacgacgtaggtaacgaacgaacgtacgtacttaaacgtttagtttaagtacggtacgtaaacgtaagtttacggtttacggttacgggttacgaaacgttacgtaaacgttaggtaaaggttggggtacgggttaaagggttcgggggtaccgtaccggttacccggaacccgggtaccgggtaaccgggggtaacccggtaaaacgggtacccgttacgggttacccgggttaaccccgttaccggttacccctaccgggtaacccgtaaccccggtaccccctaacccggggtaaaaccccgggtaaccccgggtaccccccgttaacccgggtttaccccccgggtttcccccccgtttaccccccggtaaccccgggtaacccccctttaacccccccggttacccgtaaaacccggaacccgggtaacccgtcccccgttaaacccgggggg

SEQ ID NO: 42998 - DNA, 660 bp, Homo sapiens
  misc_feature: GYAE6OF01CMGXP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtggggtcccgccacggcccccaggcgaaaggggactgggaggtgggtggctatttataactaatttgataggaagtaaattaaaaaagttttcgacagaccgtccggtaggaacgggccgattccaccatctccagacacccttaccaacatacgctgtactccaccaaatcgaactagtggtagactagttacgaaagacacggtactaaactttatttatggtagaacggtaaagtacgtttcgggttaggttacgagtactaatacgtaagttgggtaggtaagtaggggtcgccgtacgacaccgggtggggaccaagggactcgtggtacctccgtctcctacgccgccctacccgaccgaacgggcccctacgttcccggttccccgttcccccgcggtaccccctaccccgttccctaacccgaacggtccgtccccgtacccgg

SEQ ID NO: 42999 - DNA, 785 bp, Homo sapiens
  misc_feature: GYAE6OF01DLB52.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgtgtctgaattcatcctcaggcactatggcatgcacgtgggtcccnccgaacggccccaggcgaaagggtctgggaggtgggtgctattttaagactaagtttgaagtaggaagtaaattaaaaaattttacgactagaaccgtccggtaggaacgggtcctattaccaaccgattacctaccgaaggacctaacccctttaacccaaacctactaccggtacttacgttaactcccttaaccgaaaattacggaaacctagttagggtacgaacgtaaggttacggaaacgaaccgtaacggtaactaacttttaagttaattggacgtacggtaaagtagtttccgggtttaggttaccgagtactaagtactaaagtgggtaggtagtacggggttgaccgtacggaacgtacccggacgggggtacccgaaggggaaccctaccggtgggttaacccctccgttacccgtcccgtacgacccggtccctaaacccgaacccggaaacccgggtcccctaagttcccccgggttaccccttcccccggtaccgacccccgtaccccccttacccggtaaaccccgaaaggtcccgacccgttaacccccggg

SEQ ID NO: 43000 - DNA, 689 bp, Homo sapiens
  misc_feature: GYAE6OF01CSLSW.31.14.B03.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcacgtgggtccnccaggccccaggcaagggctggagtgggtgctatttatacaatttgatggaagtaattaaaaaatttcgacagactcgtagaacgggccattccaccatctaccagacgtacccttaccaacatacgctgtactctacaaatgaacagttggagactagttagaagacgacggtactaaactttattatggtagaacgtaaagtacgtttcggttaggtcgaagtctaatactaagttggtaggagttaggggtcgtaccgttacggaccgtaccgggtcgggggaccgaacggggtaacctaccggttcgggtacctaacccggttccacccgttacgaaccggtcccctaccccggaaccggtaaacccggggtcccctaaggtttccccggttccccctttacccccggtccgggtaccccctaacccccgttacccgtaacccgaaacggtcccgtcccgttaaccccggg

SEQ ID NO: 43001 - DNA, 640 bp, Homo sapiens
  misc_feature: GYAE6OF01ASRSP.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggactgggagtgggtgctatttanactaatttgatggaataataaaaatttcgacagactccggtagaagggtccattcaccatcctccagacgtacccttccaacactacgctagtactctaccaaatgaactagtgtacgactaggttagaagaccgacggactaacttattagttagngacgtaagtcttaggttaggttcgagctatactaagtgtaggtagtagggtcgtacgtcggactaccggtcggggaccgaagggacctacgtcggttaccaccgttccctcctccgacgtcccctacccaacccgggtaaccgggtcccctacggttcccggttccccttaccccccggtggtacccctacccccgttaccacccgaacgtaccggtcccgtacccggg

SEQ ID NO: 43002 - DNA, 582 bp, Homo sapiens
  misc_feature: GYAE6OF01BFVWU.31.14.B03.1.454.CMB.1.raw
  modified_base (253)..(253): a, c, t, g, unknown or other
  misc_feature (253)..(253): n is a, c, g, or t
  modified_base (463)..(463): a, c, t, g, unknown or other
  misc_feature (463)..(463): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggctgagctgggtttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgctatttanacaatttgatggagataaaaatttcgcagactccgtgaggccgattcaccatcctccagacgacccttccaaccataccgctgtatctaccaaatgaacatggtagactagttagaagacacggactaactttattattgtagacgaagtagttcgttgtcgagcatacatgtaggtatagggtgctcgacaccgtgggccagggaaccncgtggtccaccgtcctccgtcacgtccctaccgacccgtaacgggcccctagttcccggtccctttccccccgnggtccccacccccttacccgtacccaacggcgcccgtaaccccgg

SEQ ID NO: 43003 - DNA, 779 bp, Homo sapiens
  misc_feature: GYAE6OF01DXF9C.31.14.B03.1.454.CMB.1.raw
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtggggggtccctggagactctcctgtgccatgtctgcgtctgaattcatcctcaggcactatggcatgcacgtgggtcccgccacgggccccaggcgaaggggactgggaggtgggtggctattttanactaatttgagtaggaagtaattaaaaaaatttacgactaagacctccggtaggaagggccgtaacttcacctactcctaccgtaagaaccgtacccctttacccaaaccgtacttaaccgtacttacgtaacttacctaaaccctaaaacttacggtaaaccgtaacgttacgggggtacgaaaccgtaagggtttacgggaaacgtaacccgtaaaccggggtaacctaaaaccgttttaagttttaagttacgggtaacgtacgggtaaaaagttcggtttacgggttttacgggtttacggacggtactaacgtactaaaggttcggtagggtaaggtaggggttcgggaccttacgggacctacccgggtcggggaacccggtaagggaaccgtcgggtaacggtcccgtaacccggtctcccgtacaccggtccctacccgaaccgtacgggccctaacgtccggttcccttccccggcgtcccacccctcacccagtccgctacccgg

SEQ ID NO: 43004 - DNA, 663 bp, Homo sapiens
  misc_feature: GYAE6OF01EQTQI.31.14.B03.1.454.CMB.1.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggcccccaggcaagggactggagtgggngctatttanactaatttgatggagaataaaaaattttacgacagactccgtaggaacggccgtattcacactctccagacgacccttccaaccatacgctgtactactaccaaatacgaactagtggtgactagttaggaagacacggactaaacttattattgtacgacgtaaagtacgtttcgttggttacgagcgtatacaagttgtaggagttagggtcggtcgttacggacgtaccggtcggggaccgaacggggaactaccgttaggttaccctacccggttcctcccgttaccgaccgccccgtacccccgaacgtaacccggggtccccaacgttcccgggtcccctttacccccccgtcggacccccttacccctccccgtaccaaccggcgtcccgtaaccccggg

SEQ ID NO: 43005 - DNA, 608 bp, Homo sapiens
  misc_feature: GYAE6OF01C57KC.31.14.B03.1.454.CMB.1.raw
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggcatttanacaatttgatggagaataaaaaatttcgacagactccgtagaggcattcaccatctcagacncccttacaaccatacgctgtatctaccaaatgaacatggtnacagttgaagacacgataacttattatgtgacgaaagtnttcgttggtcagctaatcgaagttggtaggtaagttaggggtcggcttacgacctaccggttggggaaccctaaggggaactacgtcggttaccgaccgttcctccctacgaccgtccctaccccaaccgaaccgggtaccccattcccgggttcccttaccccccgtggacccctaccccctccctacctaacggaccgtccctaaccccggg

SEQ ID NO: 43006 - DNA, 770 bp, Homo sapiens
  misc_feature: GYAE6OF01AMSPK.31.14.B03.1.454.CMB.1.raw
  modified_base (219)..(219): a, c, t, g, unknown or other
  misc_feature (219)..(219): n is a, c, g, or t
  modified_base (659)..(659): a, c, t, g, unknown or other
  misc_feature (659)..(659): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcggggtcccnccgacggccccagggcgaaggggactgggaggtgggtgctatttatactaagtttgataggaagtaaattaaaaaattttcgacgaagaccgttccggtaggaacgggtccgtaatttaccgaaccctattcctacccgaacgtaaccgtaccccctttacccaaacctaacgttaccggtaccttacggtaacttaccgtaaaccctaaagttacggaaacctagtcggggtacgtaacgtaaggttacggaaacgtaaccgaacggtaacttaaactttaatttagttacggtacggtaacgtaaaggttacgttttacgggtttacggttacgaacgtactatacgtaagttgggtagggtagtaggggtcgtacgtccggacgtaccgggtcgggaaccgaacgggactacggtcggtccaccggttcctccgtcnccggtccctaccgaaccggtaccggtcccctacggttcccggttcccccttccccggtacggtaccccctaccccgttacccaacccggaacgtcccggaccgtacccggg

SEQ ID NO: 43007 - DNA, 842 bp, Homo sapiens
  misc_feature: GYAE6OF01CDAVB.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccacggccccaggcaaggggactgggagtgggngcatttatactaatttgataggaagtaaattaaaaaaattttacgacaagaccttaccggtaggaaacggggtccgtaatttaccgaacctacttcctacccgaaacggaaccgtaaccccctttacccgaaaaccctaagttaacccggtacttagttaactacctaaccaaaaagtacgaaacagttagggtagtaacgtaaggttaacgaaacggaaccgaacgggtaacctaaacgttttaatttaagtttaggtacggtaacgtaaaaggttacgttttacggtttacgggtttacgacgtactaactacgtaaacgttggtaagggtaaggttaacggggtcggtaccgtaccggtaaccgtacccgggtagggggaccccgtaaaggggaaccgtaaccggttccgggtaaccctacccggttaccgttccccgtaccgaacccggtccccttacccggaaacccgtaaccggggtaccccctaacggttccccggttccccctttaccccccggtcggtacccccgtaacccccccgttacccgtaaccccggaacggtaacccggtccccgtaaccccggg

SEQ ID NO: 43008 - DNA, 751 bp, Homo sapiens
  misc_feature: GYAE6OF01ACRE7.31.14.B03.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctgaggcactatggcatgcacgtcggggtcccnccgaacggccccagggcaacggggactgggaggttgggngtctattttaanactaatttggaatggaataattaaaaaatttcgacagtactccgtggaaacggggccattccaccagtcctaccgaagaccgtaaccccttaccaacctataaccgtctacgtaactcctaaccaatacgaactagttgacgactacgttagaacgacacggtacctaaactttattaacgttggtacgtacggtaaagttcgttttccggtttagggttacgaacggtctaacgttacgtaaagttgggtaagggtaacggttacgggttcggtacctcggaacccgtccgggtaacggggtccgaaacgggtacgacgttccggtaccgtaccgttacccttccgacccgtaccgtcccccgaccgtaacccggtaaccggggtcccccttacggttaacccccgtccccggtttccccccggtagaccccccgttaaccccgtaccctaccccgtaacgaacggtccccctaacccgggg

SEQ ID NO: 43009 - DNA, 647 bp, Homo sapiens
  misc_feature: GYAE6OF01EPHU7.31.14.B03.1.454.CMB.1.raw
  modified_base (212)..(212): a, c, t, g, unknown or other
  misc_feature (212)..(212): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactgggaggtgggtggctattttanactaattttgagtaggaagtaattaaaaaattttacgactagactccgtgaaggccgattcacatctccagacgacccttccaaccatacgactgtactctaccaaatacgaacatggtagactagttagaagacgacggactaacttattagttgtagacgtaagtacgtttcgtaggtttacgagtacatacaagttggtaggtaggtagggtcggtcgtacgtaccgaccggtaggggacccgaaggggtaaccacggttcggtacctacccgttccgtaccctccgtacctcccgtacccgaaccggaccggtcccctagttacccggttccccttccccgtcggacccctaccccgtcccctaaccgtacgaccgtccgtaccccgg

SEQ ID NO: 43010 - DNA, 963 bp, Homo sapiens
  misc_feature: GYAE6OF01BQZFK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcacttatggacatcgcctacggtcgggtcccgccgacggcccccaagggcaaggggactggggacggtggggtcgactaattttacaacgtaagtttggagtaggtaaagtaaaatttaaaaaaacgttttacgactaaggtaccgttacccggtaagggaaacgggtacccgtaactttaccaacctaacttccgtaacccgaacggtaacccgtaacccccttaacccaaaccctacgtaacccggtcttacgttaactacctaacctaaaacgtacgtaaacctaagttacggtaacgtaacgtaacggttaacggaaacgaaccgtaaaccggtaacttaaaccttttaagtttaacgtttaggtaacggtaacggtaaaacggtttacggttttaccgggtttacgggttaacgtaacggtaccttaaagttaaccgttaaaggtttagggtaacggggttaaacgggttacggggggttccggtaccgttaacccggtaacccggtaaccgggttacgggggaacccgtaaacggggtaaaccgtaccgggttaccgggttaccccgtaacccggttccccgtttaccccgtacggtaacccggtaccccccttaacccggtaaacccccgggaaaccggggttacccccgtaacccggtttccccggtttaccccccgttacccccccgggttaccggaccccccgttaccccccgtacctaaccccccgggtaaagtaccccggtccccgttaaccccgggg

SEQ ID NO: 43011 - DNA, 602 bp, Homo sapiens
  misc_feature: GYAE6OF01DNEZV.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (408)..(408): a, c, t, g, unknown or other
  misc_feature (408)..(408): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactggagtgggtgctatttanacaatttgatggaagaattaaaaaattttacgnagactccgtgaacggccattcaccatctcagacgacccttaccaaccatacgctgtactctacaaatgaacagtggtgacagttagaagacacggactaacttattagtgtgacgtaaancgtttagttggttcgagctaatacaagtgtggtagtagggtgcctcgacctacgtcggggaccagggaaccacgtggtaccgtaccgtctcccgtctaccgccctaccaaccgaacgggcccctaacgttcccggttcccctttcccccgnggaccccctaccccgtccctaccgaacgccgccgtaacccggg

SEQ ID NO: 43012 - DNA, 765 bp, Homo sapiens
  misc_feature: GYAE6OF01A50BR.31.14.B03.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggcccnccgacggccccaggccgaagggactggaggtgggtgctagtttaactactaagtttgagtaggaagtaaattaaaaaattttcgacaagaccgttccgtaggaacgggtcctaacgttccaaccacttccgtaccgaacggtaaccgtacccccgtttacccaaaccgtacgtaccgtcgttacgttactacctaaccgtaaaatcgaaactagtaggtacgacgtagttagaacgtacgaccggtactaactttattagttaggtagaaccgtaaaggttacgtttaggttacgggttacgaacgtctaacgttacgtaagttcggtaagggtaggttaggggtcggaccgtaccggtaccgaccgggttcggggaacccgtaaacgggacctaaccgggttcggtaccctacccgttccctccgtacccaccgtcccctaacccgaaccggaaacccgggccccttacggtccccggttcccctttaccccccgtcggacccccttaccccgtaccccgtaaccaaccggtccgtcccgtaacccgggg

SEQ ID NO: 43013 - DNA, 651 bp, Homo sapiens
  misc_feature: GYAE6OF01DZCOL.31.14.B03.1.454.CMB.1.raw
  modified_base (186)..(186): a, c, t, g, unknown or other
  misc_feature (186)..(186): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctnaggcactatggcatgcactgggtcccgccaggccccaggcaagggactggagtgggtgctatttanacaatttgatggaagtaattaaaaaattttacgactagactccgtgaagggccgattcaccatctccagacgacccttccaaccatacgctgtactctaccaaatgaacatggtagactagttagaacgacgacggactaaactttattagttagtcgaagtaaaagtctttacggttggtttacgagtctaagtactaaagtgggttacggagttagggggtcggtaccgttacgaccgtaaccgttcgggggaacccaagggggaacctacgtgggtacctacccggtctcccgtcgacgtccctacccgaccgtaacgggcccctaggttccccggtcccttacccccccgtgggaccctacccccgttacctacccgaacgcgccctaaccccgg

SEQ ID NO: 43014 - DNA, 684 bp, Homo sapiens
  misc_feature: GYAE6OF01A3RK5.31.14.B03.1.454.CMB.1.raw
  modified_base (410)..(410): a, c, t, g, unknown or other
  misc_feature (410)..(410): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagctctcctgtgccatgtctgcgtctgaattcatcctcaggcactatggcatgcacgtgggtcccgccacggcccccagggcaaggggactgggagtggggtggctattttatactaatttgataggaagtaaattaaaaaattttacgactaagacctccgtaggaacgggccgtattccaacccattcctacccagaacgtacccccttaccaaccctataccgcttagtactcctaccaaatacgaactagtggtanaactaggttagaaagacacggactaaactttagttacttgtagacgtaagtagttacgttggtcgagctatacaagtggtaggtagtaggggtgcctcgaccaccggtcggggaccgaagggaaccncggtacggtacctacccgtcctaccctcgaccgtccctacccgaacccggaaccgggtcccctacggttccccggttcccccttaccccccggtcgaccccctaccccctaccccgttacccgaaacggtcccgtccgtacccccgg

SEQ ID NO: 43015 - DNA, 1013 bp, Homo sapiens
  misc_feature: GYAE6OF01C064J.31.14.B03.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtccgccaggccccaggcaagggctggagtgggtggctatttatacaatttgatggaagtaattaaaaaaagttttcgacaagtacctccggtaggaacggggtcccgtatttccgaaccctaatcccttaccgaaggtaaccggtaacccccctttaccaaacccctaagttaccccggtcttacggttaacttacccctaaccgtaaaaactcggtaaaacctacggttaggggttacgtaaccgtaaggttttaacgggaaacgtaacccgtaaccggggtaaccttaaaaccgtttttaagtttttaacgtttacgggtttaacgggtaaaccgggttaaaaaacgggttacggttttttacccgggtttttaggggggtttaccccggtaaacgggttaccgtaaacgttttaacccggtaaaacggttttagggggtttaacgggggttaaagggttttaaacggggggggtttaccggggtaccccggttttaaccccggggaaacccggttacccccggggtttacggggggggtaaacccccgtaacgggggggtaaaacccgttacccgggttacggggttaccccgtaaccccggtttacccgttcccgttaaccccgaaccgggtaccccccttacccccggaaaccccggtaacccggggggtccccctaacggtttacccccggggtttcccccctttttaccccccccgggcggttacccccctaaccccccgtttaccccccgaaccccggtaaaaccggtcccggtacccccgttaaacccccggggg

SEQ ID NO: 43016 - DNA, 776 bp, Homo sapiens
  misc_feature: GYAE6OF01A5UHB.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactagtggcatgcacgtgggtcccgccacgggccccaggccaagggactgggaggtgggtggctattttatactaatttgataggaacgtaaattaaaaaattttcgacaagtacctcggtaggaacgggccgaattccaaccgtatcctaccaggaccgtaacccctttaccgaaacctactaccgacttagtaactacctaacctaaaagtagaaacctagtcgggtagaacgtaggttagaaacgaccgtacggtaacttaaacgtttattagtttaggacgtaacggtaaagttacgttttacgggtttaggtttaccgaacgacgtaacttacgttaaagtgggttaacgggtaacggttaaggggttccggaccgttaccgggtaacccggtacccgggttacgggggaccccggaaagggtaacccgtacggtccggttacctacccggttcgttacccgtcgtacccgtcccgtaacccgacccggtaaaccgggtcccttaccgttcccgggttccccttaccccgtcggcccctaacccccgttcctaacccgacggtcccgtcccgtacccgg

SEQ ID NO: 43017 - DNA, 723 bp, Homo sapiens
  misc_feature: GYAE6OF01AN4LA.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggccaagggactggagtgggtggctatttatactaatttgatggaagaataaaaattttcgcagactccgtgaagggccgattcaccatcctccagacgtacccttaccaaccatacgctacgtatcctaccaaatcaaccatggtagactagttagaagacgacggactaaactttattattagtgaacgtaaagtagtttcggttggttacgagtactatacgaagttggtacggtaagttaggggtcggtaccgtaccgaacctaaccgggtcggggtaccgaacggggtaacctaaccggttcgggtaccgtaacccgttccctcccgttaaccgaccggtacccctaccccgaaacccggtaaacccggggtcccccgtaaaccggttccccgggtttccccctttacccccccccggtacggtacccccccttacccccgttacccccgttaaccccgaaacccgggtacccgtccccgttaaccccccggg

SEQ ID NO: 43018 - DNA, 739 bp, Homo sapiens
  misc_feature: GYAE6OF01C42WI.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcactatggcatgcacgtgggtcccgccacggccccaggccaagggactgggagtgggtgctatttatactaatttgatagggaataaattaaaaaattttacgacaagacgtccgtaggaacggggaccgtattccaacctactcctaccgaacgaccgtaccccttaccaaccataacgtctagtactctaaccaaatcgaacatggacgtaactaggttagaagaacgacggtactaaactttattatgtagaacgtaaagtcgtttacggttggttacgagtactaattactaagttggtaggtaggttaaggggtcgtacgtccggaaccgtaccgggtacgggggaccctaagggggaacctaccggttcgggtaccctaacccggttccctaccgttacccgaaccgtccccgttaaacccgaacccggtaaccgggtaccccctaccgggtttccccggttcccccgtttaccccccgttccgggtaccccctacccccgttaccctacccggaaaccggtcgaccccggttaccccgg

SEQ ID NO: 43019 - DNA, 906 bp, Homo sapiens
  misc_feature: GYAE6OF01BR4WS.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgtaattcatcctcgaggcctaacttagtggcatcggacctacggtcgggtcccaccgacggcccccgaggacgaagggaccgtgggaggtgggtgacttagtttaatactaagtttgagtaggaaagtaaaattaaaaagtttccgactaacgtacgttaccggtaggaacggtaccgtattaccgaacctacttaccgaccgacggtaacccgttaaccccttacccaaacctacgttaccgtcttacgtactaccgtaacctaaagtacgaaacgtaggttacggtaagtaacggttaggtaacggaaacgtaccggtaacccgtaactttaaacgttttagtttaacggttagtaaccgggttaaacgtaaacggttttaccggttttacggggtttagggttaaccgtagtaacgttacgttaacgttaagggtttagggtagggttaaacgggttaccgggggttacggtacccggttaacccggaaccggttacccggggtacggggaacccgggtaaacgggtaaaccctccgggttacccggtaaccctacccgggttcctacccgtaccggacccgtacccccgtaacccggaacccgggtaccccggggtaccccttacccgggtttccccgggttacccccctcccccgtacccgggaaccccccttaacccggttacccccaacgggaaacccggtcccgtccccggtaacccgggg

SEQ ID NO: 43020 - DNA, 962 bp, Homo sapiens
  misc_feature: GYAE6OF01CC1GF.31.14.B03.1.454.CMB.1.raw
  modified_base (187)..(187): a, c, t, g, unknown or other
  misc_feature (187)..(187): n is a, c, g, or t
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcctggggggtccctgagactctcctgtgccatgtctgcgtctgaattcatcctnaggcactagtggcatgcacgtgggtcccnccacggccccaggaccgaagggactgggacggtgggtagctaagttttanaacgtaaagttttgaagttacggaaagtaaaattaaaaaaacgttttacgacgtaacggtaccgttaccggtaggaaacgggtaccgtaactttaccgaaccgtacgttacccgtaccgaacggtaaccgttaacccctttaacccgaaaaccctaacgttaacccgtccgtttaacgttaaaccttacccgtaaccgtaaaaacgttcggaaaacgttacgttacgggtacgtaaaccgttaaggttaaacggaaaacggtaacccgtaaccggggtaaccttaaaacttttaacgtttaacggtttacggtaacggtaaccggttaaaggttacggttttaccgggtttagggttaccgaagtccgtaaagttaccgtaaagttagggtagggtaacggttaagggggtcgtaaccggtaccggtaaaccgtacccggggttacgggggaacccgtaaacgggggtaaaccctaccgggtttacgggttacccgtaacccggtttacccgttacccggttaacccgtacccggttacccctaacccccggggtaaacccggtaaaccccggggtcccctttaaaccgggtcccccggtttaacccccgtttccccccggtacgggttacccccccttaaccccgtaccccgtttaaccccggaaacccggttccgggccccgttaaccccgggg

SEQ ID NO: 43021 - DNA, 594 bp, Homo sapiens
  misc_feature: GYAE6OF01EBIC7.31.14.B03.1.454.CMB.1.raw
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (380)..(380): a, c, t, g, unknown or other
  misc_feature (380)..(380): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactggagtgggnggctattttanactaatttgataggaagtaataaaaaattttacgacaagactccgtaggaagggccgattcgacctatctccagacgacccttaccaaccatacgctgtatctaccaaatcgaactagtggtanactagttagaagacacggactaaacttattattggtagacgaaagtattcggttggttacgagtacaatacgaattggtaggtagtagggtgactcgacgccgtagggaccgaaggaacacgtggtaccacgttctccctcacgtcccaccaccgacgggccctagtcccgtccctccccgtgaccctaccctcctaccaacgcgcccgtaccg

SEQ ID NO: 43022 - DNA, 620 bp, Homo sapiens
  misc_feature: GYAE6OF01D7R19.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgcatttanacaatttgatggagtaataaaaaattttcgactagactccggtgaagggccgtattcaccatctcagacgacccttccaaccatacgctgtatctaccaaatgaacagtggtnactagttagaagtacacggtactaactttattacgttagtagacgtaaagtatttcggttaggttacgagtcaatactaagttggtaggtagttaggggtcgacgtacggaccgtaccggtcggggacccgtaagggtaacctacgtggtaccaccggtctcctcgacgtccctaccaaccgacgggtccctagttcccggtcccttccccccgnggtacccctcccgtacctaccgaagccgtccgtaacccgg

SEQ ID NO: 43023 - DNA, 776 bp, Homo sapiens
  misc_feature: GYAE6OF01D2Q16.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccgccacgggcccccaggcgaagggactgggaggtgggtggctatttataactaagtttgataggaagtaaattaaaaaattttacgactagtaccgtccgtaggaacggccgtacttccgaaccatcctaccgagaccgtaccctaccaacctactacgtctagtactactaccaaatacgaatagtcggtagacgtagttagaacgacgacggtactaaactttagttacttaggtagaagtaaacgttagtttccgggtttaggttacgaagtactaactacgtaagttggtacgggtagttacggggtcgtccggtaccgacgtaccgggtacggggaccgtaacggggtaacctaccgggttacggtaccttacccggttaccctacccgtaccgtaccgtaccccgttacccccggaaacccggtaaccggggtacccccgttacggttaccccgggtttccccccgtttaccccccgggacccggttaacccccccgttacccccgttacccccgaaccccgtaaacgggtacccgtccccgttaaccccgggg

SEQ ID NO: 43024 - DNA, 660 bp, Homo sapiens
  misc_feature: GYAE6OF01C0N3J.31.14.B03.1.454.CMB.1.raw
  modified_base (188)..(188): a, c, t, g, unknown or other
  misc_feature (188)..(188): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtgggtccgccacggccccaggcaagggctggagtgggtggctatttanactaatttgagtaggagtaattaaaaaatttacgacagtacctccggtaggaacgggccgattaccaccatcctccagacgacccttacaaccatacgctagtactctacaaatgaactagtggtagactagttagaacgacacggtactaactttattagtgtgaacgtaaagtcgtttacggttaggtacgagtactagtacagttggtaggtagtacggggtgtaccgtacggaccaccgggttagggggaacccgaaggggtaaaccgtcgtcgggtacctaccggttcctcccgtacgccgtaccccacccgaacccgtaacgggcccctacgttcccggttccccttccccccgacggtacccctaccccgttaccctaccgaacgccgcctacccggg

SEQ ID NO: 43025 - DNA, 559 bp, Homo sapiens
  misc_feature: GYAE6OF01BYNRM.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaaattttacgcagactccgtgaagggccattcaccatctccagacgacccttccaaccatacgctgtatctaccaaatgaacatggtgacagttgaagacacggctaaacttattattgtagcgaaagtatttcgttggttcgagcatcaatgtggatagggtggctcgacaccgtggggccagggacacgtggtccaccgtctcctcacgccctccaccgaacgggccctagtcccggttcccttcccccgtggccctacccctcctacccaacgcgcctacccgg

SEQ ID NO: 43026 - DNA, 861 bp, Homo sapiens
  misc_feature: GYAE6OF01AG2RF.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtccgccaggccccaggcaagggactgggagtgggtgctagtttanacgtaagtttcgagtagggaagtaaattaaaaaagtttcgactaaggtaccttccggtaggaacggggtacctagttaccaaccgtattcctaccgaacggaccgtaccccttaccaaaccgtacgtaccgtcttaacgtaccttaccgtaacctaaagtaccgtaacgtaagttacgggtacgtaacggtacggtttaacggaaacgtaacccgtaaccgggttaacctttaaaacgttttagtttaacggttacgggttaacggtaaaccgggttaaaagtttaccgggttttaccgggtttaacgggttaccgggaaacgttccgtaaacttaccggtaaagttggggttacggtaacggtttacgggggtacggttacccgtacccggtaaccggtaaccccggggttacgggggaaccccgtaacggggtaaccctaccgggttaccggttacccggtacccgtttacccgtacccaccggtaacccggtcccgtaccccggaacccggtaaccggtccccgttaacggttcccggttaccccgttccccgaccggtaccctaccccgtccgtaacccgaacgcccgtaccgtacccggg

SEQ ID NO: 43027 - DNA, 728 bp, Homo sapiens
  misc_feature: GYAE6OF01BCFO8.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggggtccctgagactctcctgtgccatgtctgcgtctgaattcatcctcaggcactatggcatgcacgtcgggtcccgccacggcccccagggcaaggggactgggaggtgggtggctatttatacaatttgataggaagtaattaaaaaattttcgcaagtacgtccggtaggaacgggccgattcacctatcctaccagaccgtaccccttaccaacctataccggacttgtaactacctacctaaaatcgaaaccagttagggtacgaacgtaggttagaaacggacgacggtactaaactttaattagtttagtaggaacgtaaagtagtttacggtttggttacgagtccatacaagtcggtaggtagttaggggtcgccttaccggacctaccgggtcggggtaccgaacggggtaacctacgtcgggttaccctacccggttcctcccgtaccaccgtccccgtacccgaacccggaccgggtacccctacgttccccggtttccccgttacccccccggtcggaccccccttaccccgttaccccgtaacccgtaaccggtccccgtaccgtaccccggg

SEQ ID NO: 43028 - DNA, 599 bp, Homo sapiens
  misc_feature: GYAE6OF01BNK2J.31.14.B03.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (380)..(380): a, c, t, g, unknown or other
  misc_feature (380)..(380): n is a, c, g, or t
  modified_base (498)..(498): a, c, t, g, unknown or other
  misc_feature (498)..(498): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccnccacggcccccaggccaagggactgggagtgggtgcatttanactaatttgatggaagtaataaaaaattttacgacagactccgtagaacgggccgattcgaccatcctccagacgaccccttaccaaccataccgtctgtactctaccaaatgaacatggtanactagttagaagacacggactaacttattattgtagacgaagtactttcgttaggttcgagtctaatataagtgtagtagtagggtgctacgacgtaccggtggggaccaagggaacncgtacggtccaccgtctcccncgacgccctaccgaacccgacggccctacgtccggtcccttccccgtgaccctacccctccaccaacgcgccctacccgg

SEQ ID NO: 43029 - DNA, 897 bp, Homo sapiens
  misc_feature: GYAE6OF01EVVY4.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagctctcctgtgccatgtctgcgtctgaattcatcctcgaggcctactagtcggccagttcggcctacggttcggggtcccgccgaacgggtcccccgaagggaccgtaaacgggggtaccgttggggtaagggttcggggtacggtaccttaagtttttaacgtaacgttaagttttggaacgttagggtaaagtaaaacgtttaaaaaaacgttttccggacgtaacggtaaccgttaccgggtaacggaacggggtacccgttacttaccgaaccgtacgttaccgtaccgaacggtacccgtacccctttaccaaaccgtacgttaccgtcgttacgttaacttaccgtaaccgtaaagtacggaaacctaggttcggtaacgtacgtaagttacggaaacgacgtaaccggtacttaaacgtttagttaagttcggtaacggtacgtaaaacggtttcgtttacgggtttacggttacgtacggtacttaacgtaccgtaaaggttcgggttaagggtacggttaacggggttacggaccgttacgggtaacccgtacccgggtacgggggacccgtaaggggtaacctacggggttaccgtacccgtacccgttcgtacccgtcgaccgtaccccgtaccgaacccggtaaccggtcccttacggttccccggttcccttaccccccggtagtcccccgtacccccgtaccgttaaccgaacggtccgtcccgtaacccggg

SEQ ID NO: 43030 - DNA, 707 bp, Homo sapiens
  misc_feature: GYAE6OF01ASYOM.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggagaggcgtggtccggcctggggggtccctgagactctcctgtgccatgtctgcgtctgaattcatcctcaggcactatggcatgcacgtgggtccnccaggccccaggcaagggactggagtgggtggcatttatacaatttgatggagaataaaaatttacgcagactccgtgaaggccgattcaccatctccagacgacccttaccaacctactaccgtctgtactcctaccaaaattcgaaacagtggtagactagttaggaaagacgacggactaaactttatttagttagtagtacggtaaagtacgttttcggttaggtttccggaagtctaaattaccgaagttggttaggggtaagttacgggggtaggtaccttacggaacccgtaacccggtcgggggtaacccgaacggggtaaacctaccggttacgggtaccgtaacccggttccttacccgtccaccggtaccccgttacccgaaacccgtaaccggggaccccctaagttccccgggttcccccttccccccggtcgggtacccctaccccctaccccgttacccaaaccggtccgtaccccg

SEQ ID NO: 43031 - DNA, 782 bp, Homo sapiens
  misc_feature: GYAE6OF01BO8ON.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgccacgtcgggtcccnccgacggccccaggcgaagggctgggagtgggtgctatttagactaagtttgataggaagtaaattaaaaaacgtttcgactaagtaccgtaccgtaggtaacggggtcccgtaactttccaacctacgttccctacccgaacggtaaccgtaaccccctttacccgaaaccctacttaccggccttagtaactccctaacctaaagtcgaaactagttacgggtaacgacgtaaggttacgaaacgtaaccgaacggtacttaaacttttagttagttaggtacgggtaaccgtaaaggttacgtttacgggttacggttacgtaacgtactaagttaactaaggttagggtagggtaaggttaaggggtccgtacgtaccggaccgtaaccgggtcgggggaaccctaaggggtaacctacgttcgggtaccctaccgttcgtacccgtacgtaccggaccccttacccgaaacccggtacgggcccctacggttacccggttcccccttaccccgtcggaaccccctcccctaccggacccgaacgccgtcccgtacccggg

SEQ ID NO: 43032 - DNA, 704 bp, Homo sapiens
  misc_feature: GYAE6OF01BUVAH.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccnccgacggcccccaggcgaagggactgggagtgggtggctatttatactaatttgatggaagaattaaaaatttcgacagacctccggtagaagggccattcaccatcctccagacgtacccttccaaacctataccgctagtactcctaccaaatgaacagtaggtagactagttgaacgacacggtactaacttattattgtagacgaaagttactttcggttaggttacgagtactaagtacaagttcgggtaggaagttaggggtggcccttacggaacccgtaccgggttcgggggacccgtaaggggtaaccctaccgggttcggtaccctacccgggttcctaccccgtacgacccggtccctacccgaacccggaaccggggtcccctaacggttcccgggttaccccctttcccccccgtacgggaccccctacccccgttaccccaccccgaaacggtcccgacccgtaaccccggg

SEQ ID NO: 43033 - DNA, 683 bp, Homo sapiens
  misc_feature: GYAE6OF01BZ8YW.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggaggtgggtgctatttatactaatttgatggaagtaattaaaaattttacgcaagactcggtaggaacgggccgattcaccactctaccagacgtaccccttaccaacctatacgcttagtacttcctaccaaatacgaactagtggtagactaggttagaacgtacgacggtactaaatttattagttagtaggaacgtaaagttacgtttacggttagggttacgagtactaagtacgtaagttgggtagggtagttcggggtcggtcctacggaccgtaccggtcgggggacccaaggggaaccctacgttacgggtacctacccgttctacccgtcgaccgcccctaccgaacccggaaccgggtccctacgttcccggttcccttcccccggtcgtaccccctaccccttacccgtacccaacggtccgcccgtacccgg

SEQ ID NO: 43034 - DNA, 783 bp, Homo sapiens
  misc_feature: GYAE6OF01EEY2N.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatcgtgggggagcgtggtccggcgtggggggtccctgagactctcctgtgccatgtctgcgtctgaattcatcctcaggcatatggcatgcacgtgggtcccnccgacggccccaggcaaggggactgggaggttgggtggctaatttatactaatttgattgggaataaattaaaaaattttcggactagacgttccggtaggaacgggacctattcacctatctccagaccgtacccttaccaaccactacgctcgtactcctaccgaaatcgaactacgtaggtacgaacgtaggttagaaacgaacgtaaccgggtactaaacgtttagtttaagtttcggtacggtaaccggtaaaaggttacgttttacgggtttacggtttacggaacgtaccgtaattaccgtaaagttggttagggtaacggttacgggggtacgtaccgttacccggaaccgtacccgggttacggggaacccgaacggggtaaccgtaccggttaccggttacccgtacccgggttcctacccgttacgacccggtacccgtaccccggaaaccgtaacccggggtaccccttacggttaccccgggttcccctttaccccccggtcggtaccccctacccccttacccgtaacccgtaaagcccgtacccgtacccggg

SEQ ID NO: 43035 - DNA, 681 bp, Homo sapiens
  misc_feature: GYAE6OF01BBG1R.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctgggggtccctgagactctcctgtgccatgtctgcgtctgaattcatcctcaggcactatggcatgcacgtgggtcccnccaggccccaggcaagggactggagtgggtgctatttanacaatttgattggagtaataaaaatttcgacagactccgtagaacgggccgtattcaccatcctaccacgacgtacccttaccaaacctacgtacgcttacgtactacctaaccaaatcgaaactagtggtacgaacgtaggttagaaacgacgaccggtacttaaactttatttaagttgtacgtaacgtaaagttacgtttacggttggttacgaagtactaatactaagttgggtaggtaacgtaggggtcgtcgtacggaaccgtaccgggtcggggaccgaagggaaccgtacggttacggtaccctacccggttcctacccgtcgacgtccctacccgaaccggaaccgggtccctacgtcccggttccccttaccccgtcggacccctacccctaccgtacccgaagccgccctacccgg

SEQ ID NO: 43036 - DNA, 804 bp, Homo sapiens
  misc_feature: GYAE6OF01DFM43.31.14.B03.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatccctnaggcactagtggcatgcacgtcgggtccnccgacggccccaggccaagggctggagtgggtgctatttanactagtttgatggaagtaaattaaaaatttcgacaacgtacgttaccggaggtaacgggacctacgttaccaaccgtacttcctacccgaacgacccgtaacccctttacccaaacctacgtaccggaccttagtaacttacctaacctaaagtacgtaaactagttacggtaacgtaacgtaggttacgaaacgaaccgtacggtaactaacgtttaatttagttacgtacggaacgtaaagttacgtttcggttaggttacgagtactaagtacgtaagttaggtacgggtaagttacggggtcgtacccgtaccgtaaccgtacccgggtagggggaccccgtaagggtaacccgtcgggttaccgtacccgtacccgttaccttccccgtaaccgtaccgtaccccgaccccgtaacccgaaacccggggtcccccttaaccggttaccccggttcccccgtttaccccccgttacccggacccccgttaccccccgtaccccgttacccgaaacccgtccgggtacccttacccccgggg

SEQ ID NO: 43037 - DNA, 757 bp, Homo sapiens
  misc_feature: GYAE6OF01DXIPD.31.14.B03.1.454.CMB.1.raw
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgattcatcctcaggcactatggcatggcacgtcgggtcccnccgacggccccagggccaagggctggaggtgggnggactatttanactaatttgagtaggaagtaaattaaaaaacgttttacgactacgtacgtccgtaggaacggccgtattaccacctatcctaccgacgaccgtacccttaccaaccatacgctgtactcctacaaatagaactagtaggtacgactaggtacgaacgtacgacggtactaacttatttattaggtagaagtaagtacgtttcggttaggttacgatactaagtacgtaagttggtagggtaacggtaggggtcgtaccggtacgtaaccgtccgggtacggggtaaccgaaggggtaacgtaccggtccggtaccgtaccccggttctcccgtaccgtacccgtaccccgttacccgaacccggaacccggggtccccctacgggtttaccccgggttccccccctttaccccccgggtcccggtaccccccgtaaccccccgttccccgaaacccgggtaaaccgtacccggtaccccgttaccccccgggg

SEQ ID NO: 43038 - DNA, 788 bp, Homo sapiens
  misc_feature: GYAE6OF01A681N.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggctggagtgggtgctatttanacatttgatggagaataaaaatttcgacagactcgtagaagggccgattcaccatctaccagacgacccttccaacctataccgctcgtactctaccaaatacgaactagtggtagacgtaggttacgaaacgacgtaacgggtactaaacgtttagtttaagttcggtagacggtaaaagttacgtttcggtttaggttcgaagtactaataccgtaagttcgggttagggtaaggttaggggtacggtaccgttaccggaacccggtacccgggttacggggggaacccgtaacgggggtaaaccctaccgggttacggggttacccctaaccccggtttcccgtccccgttaaccggaacccggttaccccctaaccccggaaaccccgggtaaacccggggtaccccccttacgggtttacccccgggtttcccccccttaccccccccgggttaccgggaaccccccttaaccccccggtacccccttaaccccggaaaaccggttcccggtaaccccggttacccccggg

SEQ ID NO: 43039 - DNA, 915 bp, Homo sapiens
  misc_feature: GYAE6OF01DYL4E.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcgaggctactagtggacatgctacgttcggggtcccgccaacgggcccccagggaccgtaaaggggacttggggaggttggggtaggtaccttaattttaactaactaagttttgaagttagggtaaagttaaaactttaaaaaaacgttttccgacgtaggaaccttccggtaggaaacgggtccgtaatttccaacctacttccgtaccaggtaacccgtacccctttaccaaacctacgttaaccgtcgttacgttaacctccttaaacaaaacgttacgaaaccgttagttacgggtacggtaaccgttaggtttaacggaacggtaacccgtaacgggtaacctttaaaacgtttagttttacggtttaagttacgggtaaaccggttaaagtttcgtttttaccggggtttacgggtttacgaaccggttactaacgttacgtaaaaggtttcgggttagggttaagttacggggggtcgtaccgtacccgggtaaccgtaccggggtacgggggtacccggaaacgggtaacctaccgggttaccggttacccgtaacccgttcccctaccgtccgtaacccgtcccgtacccgaacccggtaaccgggtcccctaacgggttccccggtttccccccgttacccccgggtcccggtaccccccttacccccgtttacccgtaaacccggtaaccgacccgttccccggtaaccccgggg

SEQ ID NO: 43040 - DNA, 832 bp, Homo sapiens
  misc_feature: GYAE6OF01DHH6N.31.14.B03.1.454.CMB.1.raw
  modified_base (208)..(208): a, c, t, g, unknown or other
  misc_feature (208)..(208): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtggggggtccctgagactctcctgtgcctatgtctgcgtctagtaattcactcctcgaggcctaacttagnggctatcggcctacggttcggggtccccaccggaccgggacccccgagggaaccggaaaggggtaccgtggggacggtggggtacggtacttaagttttaactaactaagtttaggtaagtagggaaacgttaaaatttaaaaaaacgttttaccgacgtaacgtaaccgtaccggtagggaacgggtacccgtattacccgaacctacgttcctaccgaacgtaacccgtaccccttaaccaacctacgtaccgtctacgtactacctaaccaatacggtaactaggttaggtacgtaacgtaagtacgaacgaacgtacgtaactaaagtttattacgtggtagtaacgtaagttagtttcggttacggtacgatacgtaactacgtaagtgggttaaggtacggttgggtacgtaccgttaccggaaccggtaccgggtacggggaaccggtaacgggtaacgtcgggttaaccggttaccgtaacccgttcccgtacctaccgtacccgtccctaacccgaaccggaacccgggtccctaccggttccccggttaccccgttccccgaccggtacccctaccccggtacccaaccgaacggcccgtcccgtaacccgggg

SEQ ID NO: 43041 - DNA, 772 bp, Homo sapiens
  misc_feature: GYAE6OF01EA586.31.14.B03.1.454.CMB.1.raw
  modified_base (219)..(219): a, c, t, g, unknown or other
  misc_feature (219)..(219): n is a, c, g, or t
  modified_base (642)..(642): a, c, t, g, unknown or other
  misc_feature (642)..(642): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgctacgtcgggtcccnccaccggccccaggcgaagggactgggaggtgggtgctaatttatactaatttgagtggaataaattaaaaaattttacgactaagtaccgtccggtaggaacgggccgtaacttaccaacctattcctacccgaacggaacccgtacccctttacccgaaacctagtaccgcttacgtaactacctaacccaaatacgaaaccgtagttcggtaacgacgttaggttaacggaaacgtaccgtaaccggtaccttaaaacgttttatttaagttcggtaacggtaacggtaaaagttcggtttacggtttgggttacgacggtactattacgtaagttgggtaggtaggtagggtcgtacgtaccgacgtacccgggtggggacccgaagggtaacctacggtcggtaccctacccggttcncccgttaccgacccgtcccgtaaccccgaaccggtaacccgggtccccttaacggttccccggttccccttccccccgtcgacccccttaccccctaccctaaccgaaccggtccgcccttaccccgggg

SEQ ID NO: 43042 - DNA, 697 bp, Homo sapiens
  misc_feature: GYAE6OF01D1PF6.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaatttcatcctcaggcactatggcatgcacgtgggtccnccaggccccaggcaagggctgggagtgggtgctatttanactaatttgagtaggaagtaattaaaaaattttcgacagtactaccgtaggaacgggcctattcaccatcctaccagacgacccttccaaccatacgctgtactctaccaaatcgaactagtggtagactagttagaagacgacggtactaactttattagttagtagacgtaaagtcgttcggttggttacgagtctagtactaagttggtacgggtagttaggggtcgtacgtacggaccgtaccgggtacggggacccgtaagggtaacctaccgggttacggtacccgtacccgttaccgtcccgtacgtacccgtccctaccccgaaaccgggtaacccgggtccccttacggttccccggtttccccttacccccccggtgggtaccccctacccccgttacccgtaacccgaaacggtcccgacccgtaccccggg

SEQ ID NO: 43043 - DNA, 698 bp, Homo sapiens
  misc_feature: GYAE6OF01DZRL6.31.14.B03.1.454.CMB.1.raw
  modified_base (223)..(223): a, c, t, g, unknown or other
  misc_feature (223)..(223): n is a, c, g, or t
  modified_base (668)..(668): a, c, t, g, unknown or other
  misc_feature (668)..(668): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtgggggtccctgagactctcctgtgccatgtctgcgtctgaattcatcctcaggctactagtcggcagtgaccacgttcgggtcccnccgacggccccaggccaagggctgggagtggtgactagtttataacgtagtttgagtaggaagtaaattaaaaacgttttacgctacgaccgttccgtaggtaacgggacctagttcaccgtactacctaccgagaccgtacccttacgaaaccctataccgacttgtactacctaaccgaaaatcgaacgtagttcggagtaaccgtaggttacgaaacgacgtacggaacttaaacgtttagtttagttacgggtaacgtaaccggttaaaagtccgttttaacgggttacgggtttacgaacgtctaagtaccgtaaaggtttggtaacggtagttacgggtgtaccgtccggaacgacgggtcggaacctagggaactcgtacgttccacgtcctccgactcgcctaccgacgaaccggcctagttcccgtccctccccgngccctaccaccctacgaacgcgccctacgg

SEQ ID NO: 43044 - DNA, 703 bp, Homo sapiens
  misc_feature: GYAE6OF01CF9TP.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtcccncaggccccaggcaagggctggagtgggtgctatttanacatttgatgaagtaattaaaaatttcgacagactcgtagaaggcgattcacctagtctaccgagacgtacccttacgaaccataccgctacgtactacctaccaaatcgaaactagtaggtacgacgtaggttagaacgtaacgaaccggtacttaaacgtttaacttagtttacggtacggtaacgtaaagttacggttttacggttagggtttacgaacgtactaacttacgtaaagttcgggttaaggtagtagggtttcgaccgtacgtaaccgtaccggtggggacccgtaaggggaacctacgtcggtacctaacccgttctccgtaccgacgtccctacccgaacccggaaccggtcccgtaacggttcccggttccccgttacccccgtacgggacccctaccccgttaccctacccgaaacggtccgtacccgtacccggg

SEQ ID NO: 43045 - DNA, 755 bp, Homo sapiens
  misc_feature: GYAE6OF01BAX6V.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatggcacgtgggtccgccacgggccccagggcaaggggactgggaggtgggtgctatttatactaatttgataggaataaattaaaaaattttcgacagtaccgtccggtaggaacgggccgtattacaccgatcctaccgaagtaccgacccttaccaaaccataccgtctagtactcctaccaaatcgaaactagtggtacgacgtagttagaaagacgacggtactaaacttattagttgtagacgtaaagtacgtttcggttaggtacgaggtactaagttacgaaagttggtaggtaagttacggggtcgtaccgttaccggaaccgtaccgggtcggggtaacccgaacggggtaaaccctaccggtttacgggtacccctaacccggttcccttacccgtacgtaccggtaccccctacccggaaacccggtaaccgggtccccctaacggttccccgggtttaccccccttcccccccgggtacggtacccccctaacccccgttacccgaacccgtaaaccggtcccgtcccgttaaaccccggg

SEQ ID NO: 43046 - DNA, 743 bp, Homo sapiens
  misc_feature: GYAE6OF01CAEHG.31.14.B03.1.454.CMB.1.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
  modified_base (551)..(551): a, c, t, g, unknown or other
  misc_feature (551)..(551): n is a, c, g, or t
  modified_base (701)..(701): a, c, t, g, unknown or other
  misc_feature (701)..(701): n is a, c, g, or t
tcagcagtagacgtcacgaccggtgctcgatttagtgtgagtagtttgggctgagcggtggtttcgtcgtaggctctttaagaggtgtccagtgtcaggtgcacctggtggaatcgtggggaggcgtggtccggcctggggggtccctgagctctccgtgtgccatgtctgcgtatgaattcatcctacgaggccatagtggctagtgcgtcggtccggaccnccgaccggacccgaggaacggtaacggtacgagggtagggttgggngtataattttanaaagttagtttagagtaacgggtaaaattaaaatttaaaaacggttcaacgtacgtacccgtaggtaggacgggtactcgttaaccnctatccgtacgacggtaaccttaccctaacaacgtacgtacctnttaacgttacctaacctacgtaaacgtcgtaaanccgggtttaggaatacggttaagtaacgaaacgtaccggaacgtaaactttaagtttagtagttacggtaacgtaacgtagttacggttcgtaggtgtaaccgtntaaccgtagtagtagggtagtacggggtacgtgtaccgagtaccgggtaagggccgtacggaacgtaccgtcgttaaccggccttacgttccaccttacggacctacccgaacccgtaaggtcccggtaaccgttcgtcccgttaccccnccggtactccccggtactaccacgtacaacccgtcgtaccgg

SEQ ID NO: 43047 - DNA, 810 bp, Homo sapiens
  misc_feature: GYAE6OF01ERBRP.31.14.B03.1.454.CMB.1.raw
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
  modified_base (751)..(751): a, c, t, g, unknown or other
  misc_feature (751)..(751): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtccnccgacggccccaggcgaagggctgggagtgggtgctatttanactagttgagtggtaagtaaattaaaaactttcgacaagtaccgtcggtaggaacgggtccgtatttaccgacctacttcctaccgaggtaaccgtaccccttaccgaaccctagtaccgtcttacgtaacttactaaccctaaaagtacgtaaacgtagttacgggtagtaacctaaggttaacgaaacgtaaccgtacggtaacttaacgtttaagtttacgttaggtacgtaaacggtaaagttacgttttacgggtttacgggtacgtaacgtactaacgttaacgtaaggtttcgggtaagggtacggttagggggttccgtaccgtaccggaccgtaccggggtgggggtaacccgaagggtaacccgtacggtaccggttacctaccccggttactaccccgtaccgtaccggtaccccgttaccccgaaaccgggaacccgggtcccgttaccgggttccccggttccccttaaccccccggnggtaaccccccctaccccgttacccgtaaccgaaaccgtcccggcccgttaccccgggg

SEQ ID NO: 43048 - DNA, 677 bp, Homo sapiens
  misc_feature: GYAE6OF01BZP7V.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtggctatttanactaatttgatggaagtaattaaaaaattttacgcagtactccggtaggaacgggccattaccaccactcctaccagacgtaccccttaccaaccataccgctagtactctaccaaatgaacagtggtanactagttagaacgacgacgactaacttattagttgtagacgtaaagtgtttcggttggttacgagtactatactaagtggtaggtagtagggtcgtccgtacggaccgaccggtcggggacccgtaaggggtaacctacggttcggtacctacccggttcctacccgtcaccggtcccctacccgaacccgtaaccggggcccctaaggttccccggtttccccttccccccgtagggtaccccctacccccgttaccctaacccgaacgtccggtccccgtaaccccggg

SEQ ID NO: 43049 - DNA, 819 bp, Homo sapiens
  misc_feature: GYAE6OF01C23VQ.31.14.B03.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggccgtggggggtccctgagactctcctgtgccatgtctgcgtctgaattcatcctnaggcactatggcatgccacgtcgggtcccnccacggccccaggccgaaagggcgtggaggtgggtgctatttatactaatttgagtaggtaagtaaatttaaaaaaattttaccgactaacggtaccgttaccgggttaggaaacgggtaccgtaactttaccaacctaacttcctaccaacggaaccgtaaccccctttaccgaaaccctataaccgtccttacgtaactacctaacctaaaacttacgaaactagttaggtacgtacgtaaggttagaaacgtaaccgacggtaactaaactttaagtttagttaggtacggtaacgtaaaggttacgtttacgggtttcgggtttaacgagtacctaagtaccgtaaaggttgggttaggtaacggttaggggtacggaccgttaccggaaccgtacccgggtacgggggaacccgaacggggtaaacctaccggttaccgggtacccttaacccggttcccgttaccctacgtacccggtaccccctacccgaaaccccggaaccgggtcccctaacgttccccggttccccttaccccccggtacgaccccgttaccccctacccgtaccgacgacccgtcccgtaccccggg

SEQ ID NO: 43050 - DNA, 728 bp, Homo sapiens
  misc_feature: GYAE6OF01DH7L1.31.14.B03.1.454.CMB.1.raw
  modified_base (505)..(505): a, c, t, g, unknown or other
  misc_feature (505)..(505): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtcctgagactctcctgtgccatgtctgcgtctgaattcatcctcaggcactatggcatgcacgtcgggtcccgccacggccccaggcgaagggctgggaggtgggtggctatttatactaatttgagtaggaagtaaattaaaaaacgttttacgacaagtacgtccggtaggaaacgggtccgtaattccaacctatccctaccgaacggtaccgtacccctttacccaaaaccctacgtaaccgcttacgtaacttacctaacctaatacgaaactagtggtagtacgtaagttagaacgactacgactaaattagtttatggtagaacgtaagtagtttcggtttaggtacgaagtntaagtctaaggttgtacggtaggtagggtcggtaccaacggaacgtaacgggtcggggacccgaaggggaacctcgggtacggttccgtaacccgttcgtaccctacgaccctcccgtaccccgaaaccggaacccgggtccctaacggttccccggttcccccgttcccccgccggtacccctaccccgtccctaaccgaacgtcccggtaccctacccggg

SEQ ID NO: 43051 - DNA, 858 bp, Homo sapiens
  misc_feature: GYAE6OF01BNEE5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtccgccgacggccccaggcgaaggggactgggacggtgggtcggctagtttatactaatttgagtaggaataaagttaaaaaacgtttcgacgtaagtaccgtaccggtaggaaacgggtcccgtaacgttccaacctactccgtaccgaacggtaccgtaaccccttaccaacctacgtaccgtctagtactacctaacctaaatcgaactagtggtacacgtagttacgaacgacgacgtactaactttagttacgttgtacgtaacgtaaagttacgtttacgggtttacggttacgtaacgtacgtaacgtactaaaggttcggttagggtaacggttaaggggttccggtacccgtaccgggtaacccgttaacccgggtaccgggggtaaccccgggaaacgggtaacccggttaaacccgggttccggggtttaaccgtaccccccgggttaccgttaccccgttacccgtaacccgggtcccccgttaaaccccggaaaccccggtaacccgggggttaccccttaaccgggtttcccccgggttcccccgttacccccccggttacgggtacccccttacccccgggttacccctaacccggtaaaccgggtacccgtaccccgttaaccccggg

SEQ ID NO: 43052 - DNA, 865 bp, Homo sapiens
  misc_feature: GYAE6OF01BA1SY.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccnccacggcccccaggacgtaaggggactgggaggtgggtcggctaattttataactaagtttgaagtgggtaaagtaaacttaaaaaaagtttttacgacgtaacgtaacctccggtaggaaacggggtccgtactttaccaaccctattccctaccgaacggtaaccgtaaccccctttaaccaaacctacgtaacgctttacggtaacttacctaacctaaagtacgaaacctacgttagggtacgtaacggtaagtttaacggaaacgtaaaccgtaacggtaacgttaaacttttaagtttaattaacgggtagtaaccggtaaagttacggtttacggtttacgggttaccgaaaggttactaacttaccgtaaagttggggttaaggtacgggttaaggggtcgggtaccgttaacggtaacccggtaccgggtacgggggtaacccgtaacggggtaaaccgtacggtttaccgggtacccgtaccgttacccgttccgtaaccgtacccgtaccccgtacccggtaaacccggtaacccgggacccttaaccggttccccggttaccccgttcccccgggtaccgtacccccgttaccccgtaccccgtaacccgtaccggtaccgtccccccggtaccgg

SEQ ID NO: 43053 - DNA, 1016 bp, Homo sapiens
  misc_feature: GYAE6OF01CNPA2.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccnccgacggccccaggcaaggggctgggaggtgggtggactaatttataactaagttttggaagttagggtaaagtaaatttaaaaaaacgtttttacggaccgtaacggtaaccgtaccggtagggaacgggggtacccgtaacgtttaccaaccctagttaccctacccgaaacggtaacccgtaaccccctttaacccgaaacccgtaacttaacccggtcttacggttaacttacccgttaaaccctaaaacgttacggaaaaccgtaacggttacggggttaacgtaacgtaacgggtttaacggaaaacggtaaccgtaaccgggtaaccttaaaacgttttagtttaacgtttcgggttaacggtaacggttaaaaggtttacggtttttaccggggtttacggggtttaccggtaaacggtacttaacgttaaccgttaaacgggttggggttaaacggggttaagggtttaacgggggggtttacgggtaccccggtttaaccgggaacccggttaaccccgggggttacgggggggaacccccggtaaagggggtaaaccccgttaccgggttacgggtaaccccgttaaccccggtttaccctaccccgttaacccggtaccgtaccccccgttaaaccccgaaaccccgggtaaacccggggtccccccttaccgggttacccccgggtttcccccgtttacccccccggtaacggttcccccccgtaaccccccgtttaccccgtaaccccggtaaacggtccccggtaaccccgttaaccccgggg

SEQ ID NO: 43054 - DNA, 664 bp, Homo sapiens
  misc_feature: GYAE6OF01CNS7S.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccaggccccaggcaagggctggagtgggtgcagtttanactaatttgataggaagtaataaaaaatttcgacagactcgtagaaggcgtatacaccatctccagacgacccttaccaaccatacgctgtactacctactaaatagaacagtaggtagactagttagaagacacggactaacttattatcgtagacgtaagtagttcgttggtacgagactatactaatggtaggtaagtagggtcggtacgtccgaacgtacccggtcgggggacccaaggggtaaccgtacgttacgggttacccacccgtttccgtaccctccgacgtcccgtacccgaacccgaaaccggggtcccctaggttccccggttcccctttaccccccgtccggacccctaccccccgttaccccgtaccgaaaccgtccgtaccccgtaaccccggg

SEQ ID NO: 43055 - DNA, 713 bp, Homo sapiens
  misc_feature: GYAE6OF01EFLW8.31.14.B03.1.454.CMB.1.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcatgcacgtgggtccgcacggccccaggcaagggctgggagtgggngctatttanactatttgatggagtaataaaaatttcgacagactcggtgaaggcctattcaccatctccagacgacccttccaacctataacgctagtactctaaccaatcgaactagtggtanacgtaggttagaacgaccgaacggactaaacgtttatttagttacggtagtaacgtaaacgttagtttccgggtttaggtacgaacgtactaagtacgtaagttcgggtaggtaaggttacggggtacgtccgtaacccggtaaccgtaccgggtacgggggacccgaaggggtaaccctaccgttacgggtaccctaacccggtttccacccgtaccgaccgtaccccgtacccgaacccggtaaaccgggccccttaaggttccccggttcccccgttaccccggtccgtacccctaccccttcccgtaacccgaacggtacccgcccgtaaaccccggg

SEQ ID NO: 43056 - DNA, 615 bp, Homo sapiens
  misc_feature: GYAE6OF01BITVY.31.14.B03.1.454.CMB.1.raw
  modified_base (260)..(260): a, c, t, g, unknown or other
  misc_feature (260)..(260): n is a, c, g, or t
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatcgcacgtcgggccaccgacggccccaggtcgaagggactgggagtgggtgctatttanactattgagtagaagtaataaaaatttacgactagactacgtggaacggcgtattacaccactctaccgacgtacgtaccccttaccaacctactacgctacgtactcctaaccaaatacgaaacctagtaggtacgacgtagttagaacgtaacgacgtactaattattattagtgaagtaagtagttcgttacggtgagtctatagtaagtggtaggtagtgggtcggctacgacgtaccggtggaccgaggaccncgtacgtacaccgtcctccncgtaccgcctaccaaccggacggtccctacgttccggtccctcccgtcgcctacccctcgaccaacgcaccgtaccg

SEQ ID NO: 43057 - DNA, 548 bp, Homo sapiens
  misc_feature: GYAE6OF01B2CYR.31.14.B03.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggctggagtgggtgcatttanacaatttgatggagataaaaaattttacgcagactccgtgaagggccgattcaccatctccagacgacccttccaaccatacgcttgtatctaccaaatgaacatggtnacagttgaagacacggactaacttattattgtgacgaaagtattcgttggttcagcatcaatgtggatagggtgctcgacncgtgggccagggacncgtggtcaccgtctcctcacgccctccaccgacgggtcccagttcccggtccttcccccgnggccctaccctcctaccacgtcgccgtacccg

SEQ ID NO: 43058 - DNA, 597 bp, Homo sapiens
  misc_feature: GYAE6OF01BONXE.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactgggagtgggtgcatttanacaatttgatggataataaaaaattttcgcagactccgtgaaggccgattcaccatctccagacgacccttccaaccatacgctgtatctaccaaatgaacatggtgacagttgaagacacggactaactttattattgtagacgtaaagtatttcggttggttcgagctatcaatggtaggtagtaggggtgctacgaccgaccgtggggaccgaagggaacacgttcggtcctaccggtctacctcgacgccctaccgacccgaacgggcccctagttcccgggttcccttccccccgtgggccctacccccgttcccaacccgaagaccgcctaccccgg

SEQ ID NO: 43059 - DNA, 737 bp, Homo sapiens
  misc_feature: GYAE6OF01DF69L.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactggagtgggtgcatttanacaatttgataggagaattaaaaaatttacgacaagactccgtagaacggccgattcaccatcctcagacgacccttccaaccatacgctgtactctaccaaatgaaacagttggtagacgtaagttacgaaacgtaacgaacgggtactaaaacgttttatttaagtttacggtaggtaaccgtaaaggtacgttttcgggtttagggttaccggtaggtaccaagttactaaagttggtagggtaaggttaggggtcgtaccgttaccggtacctacccgggtagggggaacccgtaaagggggtaaaccctacggttacgggtacccgtaacccggttccttccccgtacgtaacccggtcccgtacccgaacccggaaccggggtaccccctaacgttccccgggttccccttaccccccgtcgggaccccttaccccccgtaccgtaccccgtaaacgaccggtacccctaacccggg

SEQ ID NO: 43060 - DNA, 746 bp, Homo sapiens
  misc_feature: GYAE6OF01DGKCM.31.14.B03.1.454.CMB.1.raw
  modified_base (188)..(188): a, c, t, g, unknown or other
  misc_feature (188)..(188): n is a, c, g, or t
tcagcagtagacgtcacgaccggtgctcgatttagtgtgagtagtttgggctgagctgggtttcctcgttgctctttttaagaggtgtccagtgtcaggtgcacctggtggaatcgtgggggaggcgtggtccggcgtgggggtccctgagactctcctgtgccatgtctgcgtctgaattcatcctnaggcactagtggcatgcacgtcggggtcccgccgacgggcccccagggccgaaaggggctgggaggtgggtggactatttatactaatttagataggaagtaaattaaaaaacgttttacgactaacgtactccggtaggaacgggccgtacttcaaccatcctaccgagaaccgtacccttaccaacctatacgctagtactccgtacaaatcgaaacgtagtacggtagacgtagttaagaagaaccgacggtaactaactttaatttacgttagtacgaacgtaaagtacgttttacgggttggttacgaagtctaacttacgtagtttagggtagggtaaggttacgggggtcgccgttacggaccgtaccgggtcgggggaaccaaggggtaaacctacgggttaccggtacccgtaccggttcccttccgtaccgtaccgtacccctacccgaaccggaccgggtaccctacgggtttcccggttaccccgttcccccgtacggtacccctaccccttacccgtacccgaaacggtcccgacgttaccccgg

SEQ ID NO: 43061 - DNA, 933 bp, Homo sapiens
  misc_feature: GYAE6OF01D9QL8.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtgggggtccctgagactctcctgtgccatgtctgcgtctgaattcatcctcaggcactatggcatgacacgtcgggtccnccgacggccccaggcgaagggcgtggagtgggtgactattttaatactaagttttgaagttaggaagtaaattaaaaaaacgttttcgacgtaacgaaccgttaccggtacggaaacggggtaccgtaactttaccgaacctaacttccgttacccgaaacggtaacccgtaacccccttttaacccaaaaaccctacgttaaacccggtccgttaacggttaacttaacccgttaacctaaaaacgttcggtaaaacccgtaacgtttaggggttaaccgaaactaaggggtttaaacggaaaccgtaaaccgtaaacccggggtaaccttaaaaccggttttaatttaacggtttaccgggtaacgttaaggtaaaaccgggttttacggtttttacccggggttaaggggttttaaccccggtaaggtaaccctttaaaggtttaaccgtaaaaggtttcggggttaagggtaaacgggtttaaggggtccggtacccgttaacccggaacccggtaccgggttacggggtaccccggtaaagggaacccgtaaccggtccgtttaccgaaccccgttcgtacccctaccgaaccgtcccctacccgaaaccggaaccgggtcccctaaggttccccgttccccgttcccccgtacgggttacccctaacccccggttaccctaacccaacgggtacctacccccggtacccgg

SEQ ID NO: 43062 - DNA, 839 bp, Homo sapiens
  misc_feature: GYAE6OF01C9J6F.31.14.B03.1.454.CMB.1.raw
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtgggtcccgccacggccccaggacgaagggactgggaggtgggtggctatttanactaatttgagtaggaagtaaattaaaaaattttacgactaagtactccggtaggaacgggccgtattccaccatcctaccagaacgtaccccttaccaacctactaccgctacgtaactacctaccaaatcgaaactagttacggtacgtaacgtaaggttacgaacggaacctaccgggtactaaacgttttaagtttaagtttaggtacggtaacgttaaaaggttaccgttttacgggtttacggtttacggacggtactaacgttaacgtaaggtttacggggtaagggtaacgggttaacgggggtcggtacccggttacgggtaacccgtaccccggggttacggggggaacccgtaacggggtaaacccgtaccgggtacgggttaccccgtacccggtttcccttacccgttacccgaacccggtaccccgttaaccccgaacccgggaaacccggggtccccttaaccgggttccccgggtttaccccccgttccccccggtggtaaccccccgtcccccgttaccccgtacccgtaaaccggtcccggtacccgttaaccccgggg

SEQ ID NO: 43063 - DNA, 847 bp, Homo sapiens
  misc_feature: GYAE6OF01A3Q8Q.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccaggccccaggcaagggactggagtgggtgctatttanacaatttgatggaagtaattaaaaaattttacgacaagaccgttccggtaggaaacgggtccgtatttaccaacctacttccctacccaacggaaccgtaaccccctttacccaaaccctacttaaccgcttagtactacctacctaaatacgaaactagtgggtagtaaccgtaggtttacgaaacggtaacaaccgggtactaaacgttttaacgtttatttacgggtagtaccggtaaaagttacgtttcgggtttagggttccgaagtacctaagttaccgtaaagtttcgggtagggtaaggttacgggggttacggtaccgtttaccggaaccgtaacccggggttcggggggaacccgaaagggggtaaacccttaaccgggttaccgggttaccctaacccgggtttccccttacccgttacccgacccggttaccccgtaaccccggtaaaccccgtaacccggggtacccccttaaccgggtttcccgggttcccccctttacccccccgtcgggtaaccccccttaccccccgttacccccgttaacccggaaaccgtaacccgtccccgtaaacccccggg

SEQ ID NO: 43064 - DNA, 809 bp, Homo sapiens
  misc_feature: GYAE6OF01CLF1U.31.14.B03.1.454.CMB.1.raw
  modified_base (279)..(279): a, c, t, g, unknown or other
  misc_feature (279)..(279): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcaacttatggcagtgctacgtcggggtcccaccgacggacccccgagggaccgaaagggtactgggtaggtggggtgactaatttanactaatttgagtaggaaataaattaaaaaacgtttcgacaacgtaccgtaccggtaggaacgggccgtacttaccgaacctatcctaccgacgtaaccgtacccttaccaaccgacttaccgtcttagtaacctaccgtaactaaacgtacgaaacgtagttacgggtagtacgtaaacggttagaaacgtacccggtaaacggtaacttaaaacgtttagtttaagtttggtaacgtaacgtaaaagttcggttttacgggtttacggttacgtaagtactaaacggttactaaggttgggtaagggtaggttagggtaccgtacggtacccggtaaccgtaccggggtcggggtaaaccgaacgggtaaacccgttcgggtaccggttacccgtaacccggttcctacccgtaccgaccgtacccctacccggaaccgacccgggtccttacggtcccggttcccccttacccggtccgtaacccccgtccccgttaacccaccgaaccgccggtcccttacccgggg

SEQ ID NO: 43065 - DNA, 876 bp, Homo sapiens
  misc_feature: GYAE6OF01BEX9K.31.14.B03.1.454.CMB.1.raw
  modified_base (277)..(277): a, c, t, g, unknown or other
  misc_feature (277)..(277): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgtggtccggccgtggggggtccctgagactctcctgtcgccatgtctgcgtctagaattcatcctcaggcactagtggcagtcgcacgtcgggtcccgccgacggccccgagggactaaggggactgggtaggtgggtgactattttaanacgtaagtttgaagttaggaaagtaaatttaaaaaaacgttttcgacgtaagtacctaccggtaggaacggggtacctattaccaacctactacctaccgagtaccgtaacccttaccaaactacgtaccgtccttagtactacgtaccaaaacgttanaactacgttaggtactaacgtaggttaacgaaacgacgtaacggtacttaaacgtttagtttaaggttaggtaacggtaacgtaaaggtttacgttttacgggtttacgggttacgtaacgggtactaacgttaacgtaaaggtttgggaagggttaagttcgggggtacgtaccgtaacccggtaccggacccggggttacgggggacccggaaacgggtaacccgttaaccggggttcccgttaacccggtaacccgtttcccgtacccttacccggtaacgtaccccccgtaccgaaaccccgggtaaccggtccccgttacccgggttttacccccgttccccccggtttaccccccgttaccgggttacccccctaacccccgttaccccctaaacccggtaaacccgggtcccgtaacccctaacccccggggg

SEQ ID NO: 43066 - DNA, 763 bp, Homo sapiens
  misc_feature: GYAE6OF01DFP7B.31.14.B03.1.454.CMB.1.raw
  modified_base (268)..(268): a, c, t, g, unknown or other
  misc_feature (268)..(268): n is a, c, g, or t
  modified_base (657)..(657): a, c, t, g, unknown or other
  misc_feature (657)..(657): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtgggtccggccgtggggggtccctgagactctcctgtgccatgtctgcgtctgaattcatcctcgaggcactatggcatgcacgtcgggcccgccgaacggccccgaggacgaagggactgggaggtgggtgctagttttanaactagtttgagtaggaagtaaattaaaaaattttacgactaagaccgtaccgtagggaaacggtccgtaactttaccgaccctagttcccgtacccgaaggtaacccgtaacccctttacccaaaccctaacgttacccgtacttacggttaaccgtcccttaaaccgtaaaacgtaacgaaacctaagttacgggtacgtaacgtaacggtttaacggaaacgtaaccgaccggtaactaaaacttttacgttagttcggttaacgaccggttaaaagtcgtttaggttacggttacgtaagccgtaatacgtaagttggtaggtagtagggtcgtacgtcggaacacgggtcgggaacgaacggacacgtaggtccgtaccgtccncctacgaccgtccctaccgaaccgaccgggtaccctaggttcccggtaccccgttccccgacggcccctaccctcccgtaacccgacggtacccgcgtaaccccgg

SEQ ID NO: 43067 - DNA, 874 bp, Homo sapiens
  misc_feature: GYAE6OF01D1UQ3.31.14.B03.1.454.CMB.1.raw
  modified_base (281)..(281): a, c, t, g, unknown or other
  misc_feature (281)..(281): n is a, c, g, or t
  modified_base (508)..(508): a, c, t, g, unknown or other
  misc_feature (508)..(508): n is a, c, g, or t
tcagcagtagacgtcacgaccggtgctcgatttagtgtgagtagtttgggctgagctggttttcctcgttgctcttttaagaggtgtccagtgtcaggtgcacctggtggaatcgtgggggagcgtggtccggcctgggggtccctgagactctcctgtcgccatgtctgcgtctgaattcatcctcaggcactagtggctatggcctacgtcgggtcccgaccacggcccccgagggacgaaagggtacctgggaggttggggtacggctaagttttaanaacgttaagtttagaagtaggaaacgtaaaaagtttaaaaaaacttttaccggacgtaaggtaccgttccggtaagggaacgggtacccgaatttacccaaacccgaactttccgacccgaaacggtaacccgtaacccctttaccccaaaaccctaacttaaccggtccctttagttaaccttaccgttaaacccaaaaagttacgaaaccgtaagtttcgggtanaaccgtaaggtttacgaaacggaaccgtaaccgggactttaaacctttaattagttacggtacgacggttaaaagttcgttttacgggtttagttaccggagtacctaagttacgtaagttaggttaggaaggtttacggggcgtaccggttaccggaaacctacccgggttacgggggaaccccggaaagggtaaccctaccgggttccggtaacccccgttacgttcccctaaccgtccgtaaacccggtcccctaccccgaaccggtaacccgggtacccacccggtttaccgtccccgttaccccccgtggaacccccccttaccctaccccgtaaccgaacgtcccgtacccgtaacccgg

SEQ ID NO: 43068 - DNA, 649 bp, Homo sapiens
  misc_feature: GYAE6OF01ASUGQ.31.14.B03.1.454.CMB.1.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggcccnccgaaggccccaggcgaagggctgggaggtgggtgctaagtttanaactaattgatggaagtaataaaaaattttcgacagacgtcgtaggaaggccgacttcaccatctaccagaccgaccctaccaactactacgctcgtactctacaaatacgaaactagtcgggtanaacgagttacgaagaacgacggtactaaacttatattagagacgtaagtagttcgttaggttacgagctaatactaagtgtaggagtaaggggtcgctaccggaacgaccggtaggggaccgaacgggtaaccgtacggtacgtaccgtaccgtcctcctcgaccgccctacccgaaccgtacggacccttacggtcccggttccttcccccccgtagaccccctacccgtacccctaccgaacggtacgtccccgtaaccggg

SEQ ID NO: 43069 - DNA, 759 bp, Homo sapiens
  misc_feature: GYAE6OF01AKD3L.31.14.B03.1.454.CMB.1.raw
  modified_base (203)..(203): a, c, t, g, unknown or other
  misc_feature (203)..(203): n is a, c, g, or t
  modified_base (456)..(456): a, c, t, g, unknown or other
  misc_feature (456)..(456): n is a, c, g, or t
  modified_base (527)..(527): a, c, t, g, unknown or other
  misc_feature (527)..(527): n is a, c, g, or t
  modified_base (650)..(650): a, c, t, g, unknown or other
  misc_feature (650)..(650): n is a, c, g, or t
tcagcagtagacgtcacgaccggtgctcgatttagtgtgagtagtttgggtctgagctgggttttcctcgttgtctcttttaagtaggtgtccagtgtcaggtgcacctggtggatcgtgggggaggcgtggtccggccgtggggggtccctgagactctcctgtgccatgtctgcgtctgtaattcatcctcaggcacttanggcatcggcacgttcgggtcccaccgacgggcccccagggcgtaaaggggaccttgggacggttgggggttcggactaacgtttttagaactaattttgagtggaagtaaactttaaaaaatttcgcagaccgttcgaggagggaccattcgaacctattcaccaggaactaccccgttaccaactactacgcttacgtactcctaacccaaaagttacgaactaagttcgggactaacctaaggttacgaanaacccggtacgtacttaacgttaatttcgttagacgtaacgtaaaatggtttccgttaggttacggtaacngtaacttacgtaaagtttcgggtaggtaagttaggggtcgtaccggacgtaccggaccggtacggggtaccgaaaccggggtaacaccgtcggttacctaacccggttccgactacggtaacncccccgttaaccgaacccgaacccgggtacctacccggttcccgtacgttccccccgttcggacccttacccaccccgttaccgaggaacccggttcctaacccccggg

SEQ ID NO: 43070 - DNA, 736 bp, Homo sapiens
  misc_feature: GYAE6OF01C0XO5.31.14.B03.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtgggtccnccacggccccaggcaaagggctgggagtgggtgctaatttatactaatttagataggaagtaattaaaaaagttttacgacagtactccgtaggaacgggccgtattcaacctatcctaccagacgaccccttaccaacctatacgctgtactcctacaaatgaaactagtggtacgacgtagttagaaagtaaccgacggtactaaacgtttattaattggtacgaacggtaaagtagtttaccggtttagggttaccgtaagctaattactaaagtgggtaaggtaggttacggggtacgggtaccgttacggaccggtaaccggttcggggggaccgtaacgggggtaaaccctacgttcgggacccttaacccggttcccttcctaccgtaccgtccctaccccgaaaccggtacccgggtacccctacgttcccgggtttcccccttccccccggtacggtaccccctacccccgttaccccgtacgaaaccggtccggaccccgttaacccggg

SEQ ID NO: 43071 - DNA, 786 bp, Homo sapiens
  misc_feature: GYAE6OF01DGB20.31.14.B03.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctagaattcatcctnaggcactagnggcatgcacgtcgggccnccgacggcccaggacgaaagggctgggaggtgggtgactagtttanacgtaagtttgaagtaggaaagtaaatttaaaaaatttcgacgtaacgtaccgttcggaggaacggggcctaacttccaaccacttacctaccgaacgacccgtacccttaaccaaacctactaccgcttacgtaacttacctaacctaaagtacgaacgtaggttggtacgtaaacgtagttaacggaaacgtacgaaccggtacttaaacgtttatttaacgtggttaacgacgtaaagttcgtttcggttaggttacggactagtaactacgtaagtcggtagggtaaggtcggggtagtccgaaccggtacggtacccgggtagggggaaccctaaggggtaaccctacgggtccgggttaccctaccggttcccttaccgaccgtacccgtaccccgtacccgaaacccgggtaaaccgggtcccctacgggttccccggttccccccttaccccggtcggtacccccttaaccccgtacccgtaacccgaacggtaccggtaccccttacccgggg

SEQ ID NO: 43072 - DNA, 750 bp, Homo sapiens
  misc_feature: GYAE6OF01CUZCA.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtcgggtccgccacggccccagggacaagggctgggaggtgggtgctatttataactaatttgagtaggaagtaaattaaaaaaacttttcgacaagtaccgtccggttaggaacgggtcctaattaccgaacctatcctaccgaagtaaccgtaccccttaccaaaccctagtaccggcttagtaactccgtaacctaaaatcgaaactacgtggtacgaaccgtaagttacgaaagtaccgaacgggtaactaaaccttttaagttagttggtacgtaacgtaaagttagttttccgggttaggttcgaagtctaagtacaagttggtaggtagtaggggtcgtaccgtacggaccgtaccgggtacggggaccaagggaacctacggtcggtaccgtaacccgttcttcccgtacgaccgtcccgtacccgaaccggaacccggggtcccctacggtttccccggttcccccgttcccccggtaccgtacccctaacccccgtcccgttaacccgaacgtacccgtccccgtaaccccggg

SEQ ID NO: 43073 - DNA, 584 bp, Homo sapiens
  misc_feature: GYAE6OF01DDPZF.31.14.B03.1.454.CMB.1.raw
  modified_base (253)..(253): a, c, t, g, unknown or other
  misc_feature (253)..(253): n is a, c, g, or t
  modified_base (465)..(465): a, c, t, g, unknown or other
  misc_feature (465)..(465): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcctggggggtccctgagactctcctgtgccatgtctgcgtctgaattcatcctcaggcactatggcatgcactgggtcccgccaggccccaggcaagggactgggagtgggtgcatttanacgaatttgattaggagtaattaaaaaagttttacgacagacctccgtagaaggccgattcgacactcctcaagacgacccttacaaccactaacgctagtactctacaaatcaactatgtgactagttagaagtacacgactaaacttatagttcgtagacgaaagtagttcgttaggttcgaagtcaagttacaagtgtaggattagggngctcgacaccgtgggccaaggactactggtccacgtctaccncncgccncccactaacgggcctactcccggtccttccccccgtagccccgtaccctcctacaaccgtcgctacccgg

SEQ ID NO: 43074 - DNA, 724 bp, Homo sapiens
  misc_feature: GYAE6OF01C1PW6.31.14.B03.1.454.CMB.1.raw
  modified_base (213)..(213): a, c, t, g, unknown or other
  misc_feature (213)..(213): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccnccaggccccaggccaagggactgggagtgggtggcatttatacaatttgatggagtaataaaaaatttcgacagactccgtagaaggccgtattcaccatctcagacgacccttccaacatacgctgtatctacaaatgaacatggtnactagttagaagacacggactaactttattattgtagacgtaaagtcgtttacggttggttacgaagtcctaattaccgtaaagttgggttagggaagtttacgggggtacgggtaccgttaccggaacctaacccggggttcggggggaaccccgtaagggggaaacccttaaccggttcgggggttacctaaccccgggtttcctaccccgttacgaaccggttacccctaccccgaacccggtaaaccgggggtccccctaacggtttccccgggttccccctttaccccccccggttagggcccccttaaccccccttaccccgtaccccaaaacggtacccgtccccgtaaccccggg

SEQ ID NO: 43075 - DNA, 733 bp, Homo sapiens
  misc_feature: GYAE6OF01A9K5J.31.14.B03.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (450)..(450): a, c, t, g, unknown or other
  misc_feature (450)..(450): n is a, c, g, or t
tcagcagtagacgtcacgaccggtgctcgatttagtgtgagtagtttgggctgagctgggtttcctcgttgctctttaagaggtgtccagtgtcaggtgcacctggtggaatctgggggagcgtggtccggcctggggggtccctggagactctcctgtgccatcgtctgcgtctgaattcatcctcaggcactatggcatgcacgtgggtccncaggcccaggcaagggctggagtgggtgctatttanactaatttgagtaggaagtaattaaaaaacgtttcgacaagtacttaccggtaggaacggggtcctaattaccaacctacttacctaccaagaccgtacccttaccaaccataccgctacgtatcctaccaaatcgaaactagtggtacgacgtagttagaacgacgacggtactaacttattagttgtagacgtaagtnttacggttggtaccgagtacctagttacgtaagttcggtagggtaagtacggggttcgaccgttacggaccgtaccgggttacggggaacccgtaaggggtaaccctaacggttcgggtacccgtaaccgttccgttacccgtacgtaccggtcccgttaaccccgaacccgggtaaacccgggtccccttaggttacccccggggttccccttaccccccggtaggtacccccgtacccccgttacccgtaacccgaacggtacccggtccctaacccgggg

SEQ ID NO: 43076 - DNA, 657 bp, Homo sapiens
  misc_feature: GYAE6OF01EXDXW.31.14.B03.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtggggtcccnccaggcccccaggcaagggactgggagtgggtgctatttatactaatttgatggagtaataaaaaattttacgcagactccgtaggaaggccgattcaccatccnccagacgtaccccttccaacctatacgctgtactctaccaaatnaactatggtgacaggttagaagacacggactaaacttattagttgtacgacgaaagttagtttacggtttaggttacgagtacaatacaagtgtaggtagttagggtcggacctacggaacctaccgggtcggggaccgaaggggtaaccacgtcgggtaccctacccggttctacccgtacgaccgtccccttacccgaacccggtaaccgggcccctaacgtccccgggttccctttccccccgcgggtacccctaccccgtcccctaccgaacggtcgccctaacccgg

SEQ ID NO: 43077 - DNA, 723 bp, Homo sapiens
  misc_feature: GYAE6OF01C8M7R.31.14.B03.1.454.CMB.1.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccncacggccccaggcaagggctggagtgggtgcatttanactaatttgatggaagaattaaaaaattttacgcagactcgtagaaggcgattcaccatctcagacgacccttacaaccatacgctgtatcctacaaatgaactagtgtagacgagttagaagacgacggacaactttattattggtagaccgtaaagtagtttacggtttgggttcgaagtctaattcaaagttggtaggtaaggttaggggtcggtaccttacggaccgtacccggttggggggaaccccaagggggtaaaccctacggttacgggtacccgtaacccgtttccgttacccgtacccgtaacggtcccccctacccggtaacccgaaaccggggtccccctacgggtttaccccggtttcccccgtttacccccccggttacggggtacccccctaaccccccggtttaccccgtaacccccgttaaaacggccccggtaccccgttaacccccgggg

SEQ ID NO: 43078 - DNA, 603 bp, Homo sapiens
  misc_feature: GYAE6OF01BODSU.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaattaaaaaatttacgcagactcgtgaaggccgattcaccatctccagacgacccttccaaccatacgctgtactctaccaaatgaacatggtagactagttagaagacgacgactaactttattattgtagacgaaagtattgttggttcgagcatcaatgtagagtagggtgctcgacaccgtgggaccagggacacgtcggtccacccgtctccctcgacgtccctaccgacccgaacgggtcccctaacggttcccggttccccttcccccccggtaccgggccctacccccccgttacccttacccgaaccggtccggcccctaaccccggg

SEQ ID NO: 43079 - DNA, 768 bp, Homo sapiens
  misc_feature: GYAE6OF01EDGV5.31.14.B03.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtggggtcccnccacggcccccgaggcgaagggctgggagtgggtgctatttanactaatttgataggaagtaattaaaaaacttttcgacaagtaccgtccggtaggaacgggccgtattccgaccattcctaccagacgtacccttaccaacctatacgctagttactacctaccaaatacgaaactagtggtagactagttagaacgaacgacggtactaaactttatttaacgttgtacgtaacgtaaagttgtttacggttagggttacgaagtactaacgttactaaagtttgggtagggtaaggttaggggtacggtccgttaaccggtaaccgtaccgggttacggggggacccgtaaacggggtaaccgaccggttacgggttacccgtaacccggttcctaccccggtaccgaaccggtcccctacccggtaaaacccggaccggggtaccccctaagggtttccccgggttacccctttcccccccggtcggacccccttaccccgtaccccgttaaacccggaacggtacccggtccgtaaccccgggg

SEQ ID NO: 43080 - DNA, 693 bp, Homo sapiens
  misc_feature: GYAE6OF01DPD5Y.31.14.B03.1.454.CMB.1.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (644)..(644): a, c, t, g, unknown or other
  misc_feature (644)..(644): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggcccctgagactctcctgtgccatgtctgcgtctgaattcatcctcaggcactatggcatgcacgtgggtcccnccacggccccaggcaagggctgggaggtccgggtggactatttanaactaagtttgatggaagtaaattaaaaaattttacgacagtacctaccggtggaaacgggccgtaattcaccatcctccaagaccgtacccttaccgaacctactaccgctagtatacctacaaaatcgaaacagtggtagtacagttagaaagacgacggtactaaactttattagttgtagaacgtaaagtacgttttcggttagggttacgtaagtactaatacgtaagttggtaggtaagtaggggtcgtccgtaacggacgtacccgggtgggggtacccgaagggaacctaccgttaggtaccctacccgtttcccacgtacgtccccgtaccaacccggaacgggtccccacgttcccggtccccttcccccgnggccccctaccccgtccctaaccgaacgccgtccctaccggtcccgggg

SEQ ID NO: 43081 - DNA, 965 bp, Homo sapiens
  misc_feature: GYAE6OF01CP52X.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtcgccatgtctgcgtctgaacttcactccacgaggctaacgtagtcggacagtcgacctacggttccgggtccccgacccgaaccgggcccccgaagggaccgtaaaggggacgttggggaggttggggtagtactaagttttaataacgttaagttttggaaggttaagggtaaaacgttaaaaattttaaaaaaacgttttccggaacgtaacggtaacccgttaccgggtaagggaaaccggggtacccttaaaccttacccgaaacccttaacgttaccccctaacccggaaaccggtaaaccccgttaaccccctttaaccccaaaaccgttaaccgttacccgtaccgttaacgttaaccttaaccccgttaaaaccaaaagttaaccggaaaccgttaaggttacgggtaaccggtaaacgttaagggttaaacgaaaccggtaaacccggtaaaccggtaaacccttttaaaaagttttagtttaacggttaggttaaccggtaacggtaaacggttaacgtttacggtttacggttacggtaacgtaacgtaacgtaacgtaagtaggtagggtaaggtagggtacggtacgtaccgtaaccgtaccgggtacgggtaaccggaacgggtaacgtaccgtaccgtaccgtacccgtacccgtaccgtaccgacccgtacccgtacccgaacccggaacccggtacccgtacccgttcccggttccccgttaccccctcccgggggggggtacccctaccccgtacccgtacccgaaccgtacgtacccgtacccgg

SEQ ID NO: 43082 - DNA, 694 bp, Homo sapiens
  misc_feature: GYAE6OF01CF46G.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcacgtgggtccnccaggccccaggcaagggctggagtgggtgcatttanacaatttgatggagaattaaaaaattttcgacagactcgtagaggccattcacatctcagacgacccttccaaccatacgctagtactctacaaatgaacatggtanactagttagaagacgacggactaaactttattagttgtagacgtaaagtacgtttcggttaggttacgaagtctaatacgtaaagttgggtagggtaaggttacgggggtcggtaccgttaccggaaccgtacccgggtaggggggacccgtaaacggggggaaccctaccggttacgggttaccctaacccggttcccttacccgtccgacgtccccttaacccgaacccgtaaaccggggcccctaacggttcccggttccccctttcccccccgtagggtccccctaacccccgttacccctacccgaaacggtccgtcccgtaaccccggg

SEQ ID NO: 43083 - DNA, 796 bp, Homo sapiens
  misc_feature: GYAE6OF01DO5PW.31.14.B03.1.454.CMB.1.raw
  modified_base (218)..(218): a, c, t, g, unknown or other
  misc_feature (218)..(218): n is a, c, g, or t
  modified_base (757)..(757): a, c, t, g, unknown or other
  misc_feature (757)..(757): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcactggggtcccnccacggcccccagggccaaggggactgggaggtgggtggctaattttatactaaattttggattagggaagtaaatttaaaaaaacgttttacgactaaggtaccgttacccgggtaggaaacggggtccccgtaatttaccaaacccgtaacttcccgtacccgaacggtaaccgtaaccccccttttacccaaacccctaacgttaaccggtacctttacggttaaacttcccttaaacccaaaagttacggaaaacctaggttagggtacgtaaccgtaaggtttaacgggaaacgaaccgaaccgggtaacctaaactttaatttaagttaggtagaaccggttaaaagtcgttttaccgggtttagggttaccgaagtccaagttacgtaagttggtagggtagttaagggggtcgacttacggaccgaccggttcgggggaaccaacggggaactcggtacggtcctaccgtcctcctcgacctcccgacccgaaccgaacgggtcccctagtcccggttcccttacccccgnggtcccctacccctccctaccgaacgccgccctaaccgg

SEQ ID NO: 43084 - DNA, 740 bp, Homo sapiens
  misc_feature: GYAE6OF01EF39L.31.14.B03.1.454.CMB.1.raw
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtcccggccgtggggggtccctgagactctcctgtgccatgtctgcgtctgaattcatcctcaggcactatggcatgcacgtcggggtcccgccacggcccccagggcgaaagggactgggaggtgggtgctatttanactattgagtaggaagtaattaaaaatttcgacagactccggtagaaggccgtatcaccatcctaccgagacgtacccttaccaacctatacgctacgtatacctaccaaatacgaactagtgtagacgtaggttacgaaacgtacgacggactaaactttaattaagttggtaaggacgtaaagtagtttacgggttaggttacgtagtactaagttacaagttcggttagggtaagttagggggtacgaccgttaccggaaccgtacccgggtagggggacccgaagggggtaaccctacggttcgggtaccctacccggttccctcccgtactaccggaccccttacccgggaaaccccgtaaaccgggggcccctacgggttaccccggttccccgtttaccccccggtcccgaccccgttaccccccgttaccctaacccggtaaaccggaccgtcccgtaaccccggg

SEQ ID NO: 43085 - DNA, 791 bp, Homo sapiens
  misc_feature: GYAE6OF01B6U3D.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggcccaggcaagggctgggagtgggtgctagtttanacgtaatttgagtaggaagtaaattaaaaaagttttacgactaagtaccgtaccggtaggaacggggcctaatttccgaacctagtacctaccgagaccgtacccttaccaacctagtacgtctacgtaactacctaaccaaatacgtaaacagttcggganaacgtaggttacgaacgtaacgtacggtaactaaactttagttaagtttagtacggtaacgtaaaagttagtttacggtttagggttacgaacggtactaacgttacgtaaattggggtaaggtaaggttagggtacggccgttaaccggacgtaacccggttggggaacccgtaaggggaacctaccggttcggtaaccgtaacccggttccttaccgtccgtaaccgggtaccctaccccggaaaacccggtaacccggggtaccccttaacgggttaccccggttcccccgtttaccccccggacggttacccccttacccccgttaaccccgtaacccggaacggtaacccgtccccgttaaaccccgggg

SEQ ID NO: 43086 - DNA, 802 bp, Homo sapiens
  misc_feature: GYAE6OF01BWCV5.31.14.B03.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccgacggccccaggcaagggactggaggtgggtgctatttanactaatttgataggaagtaattaaaaaatttcgcaagacgtcgtagaacgggcctatcaccntctccagacgacccttcaaccatacgctgtactactacaaatgaaacagtggtataacagttacgaaacgaacgacggtaacttaaacgtttatttaagttcgggtaagttaaccggtaaaaggttacgttttacgggtttagggttaccgtaacggtaccgtaagttaacgtaaacggttggggttaagggtaaggttaacggggggtcggtacccggttaaccgggaacccggtacccgggttaccggggggaccggtaaaacgggggtaaaccgtaaccggtttccggggtacccttaacccggttacccttaccccgtaccgtacccgggtccccttaaccccgaaacccccgggtaacgggtccccccgttaaggtttcccccgggttcccccttttcccccccggacgggttaccccccttaccccccgtaccccgttaaccccgaaaccggtaccccgtcccgttaaaccccggg

SEQ ID NO: 43087 - DNA, 563 bp, Homo sapiens
  misc_feature: GYAE6OF01AUAKX.31.14.B03.1.454.CMB.1.raw
  modified_base (412)..(412): a, c, t, g, unknown or other
  misc_feature (412)..(412): n is a, c, g, or t
  modified_base (528)..(528): a, c, t, g, unknown or other
  misc_feature (528)..(528): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtcccgccacgggcccccagggcaaggggactgggagtggggtggctatttatactaatttgatggagataaaaattttcgcagactccgtgaagggccgattcaccatctccagagacccttccaaccatacgctgtatctaccaaatgaacatggtgacagttgaagacacggctaacttattattgtgacgtaaagtnttcgttggtcgagcatcaagtgtggagtagggtgctcgacacgtgggccaagggacacgtgtaccaccgtctcctcgcgcctaccaccgacggcccagtccggtcccttcccccgnggccctacccctccacccgaacgngtcctacccgg

SEQ ID NO: 43088 - DNA, 604 bp, Homo sapiens
  misc_feature: GYAE6OF01E1MCC.31.14.B03.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctggggttttcctcgttgctcttttaagaggtgtccagtgtcaggtgcacctggtggaatctgggggagcgtggtccggcctggggggtccctgagactctcctgtgccatgtctgcgtctgaatttcatcctcaggcactatggcatgcacgtgggtccnccaggccccaggcaagggactgggagtgggtgcattttanactaatttgatggagaataaaaattttacgacagactccgtgaaggccgattcaccatctccagacgacccttccaaccatacggctgtactctaccaaatgaacatggtgacagttgaagacgacggactaaacttattattgtgacgtaaagtattcgttgttacgagactatacaagtggtaggagtagggtcgcgtacgacgaccggtggggaccaaggggaaccacgttaggtcctacccgtccgtccctaccacgtccctacccgaccgtaacgggcccctagttcccggtcccttacccccgtagcccctaccccgtccctaccgaacgccgccgtacccg

SEQ ID NO: 43089 - DNA, 838 bp, Homo sapiens
  misc_feature: GYAE6OF01CWSB6.31.14.B03.1.454.CMB.1.raw
  modified_base (418)..(418): a, c, t, g, unknown or other
  misc_feature (418)..(418): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctagaattcatcctcaggcactatggcaatcgcacgtgggtcccgccacgggcccccaggacgaaaaggggctgggaggttggggtagctaattttatactaaatttgagtaggtaagaaattaaaaaaaacttttacggacctaacggtaactccggtaggaaacgggaccgtaatttccaaacctatacctacccgaagaaccgtaacccctttaccaaaaccctaacgtaccgaccgttntaactaccttaccaaaatcgtaaaacaaggttaggtaccgacgtaaaggtttacggaaagaaccgaaccgggtactaaaactttatttaagttacgttagaacgtaaaagttatttacgggttacgggttacgaggtctaaactaacgtaagttagggtagggtaagttaggggacgggtccgtacgtaaccgacccggttacgggggaaccctaagggggtaaaaccctacgttccggggtaaccctaaccccggtttaccgtacccgttaccgaaacgtacccccgttaaccccaacccgggaaaaccgggtcccctaaacggttccccgggttccccgttttaacccccccgtcgggtaacccctaccccccgtttaacccgtacccgaaacggtaaccgccccgttaaaccccggg

SEQ ID NO: 43090 - DNA, 756 bp, Homo sapiens
  misc_feature: GYAE6OF01D5QLZ.31.14.B03.1.454.CMB.1.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
tcagcagtagacgtcacgaccggtgctcgatttagtgtgagtagtttgggctgagctgggttttcctcgttgctcttttaagaggtgtccagtgtccaggtgcacctggtggaatcgtgggggaggcgtggtccggcctggggggtccctgagactctcctgtgccatgtctgcgtctgaattcatcccccctnaggcactatggcatgcacgtcggggtcccnccgacggcccccaggccgaaagggctgggagtgggtgctattttanactaagttttgatggaagtaattaaaaattttcgacagactccggtggaacgggccgtattccaaccattcctaccgaagtaccgtacccctttaccgaaacctattaccgcttacgttactacctacccaaaagtcgaaacctagttagggtacgaacgtagtttaggaaacgaccgaaacgggtactaaactttagtttagttcgtaggaacgtaaagttagttttacgggtttaggttacgaagtctaagtactaagttgggtaggtagttaggggtcgacgttaccgaccgtaccgggtcggggacccgaaggggtaacctacggttcgggtaccctaccggttccctacccgtcgaccgtcccctacccgaacccggaaccggggccccttaacggttcccggttaccccttcccccccggtacggaccccccttacccccgtacccctaacccgaaccggtaccgccccgtaaccccggg

SEQ ID NO: 43091 - DNA, 706 bp, Homo sapiens
  misc_feature: GYAE6OF01CKRRN.31.14.B03.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggcctggggggtccctgagactctcctgtgccatgtctgcgtctgaattcatcctcaggcactatggcatgcacgtcggggtccgccacggcccccagggcaagggctgggagtgggtgctaatttatacaatttgataggaagaattaaaaaattttacgacaagtactaccggtaggaagggccgaattaccacctatcctaccagaccgacccttaccaaccatacgctgtactctaccaaatgaacagtggtanaacagttagaagacgacggactaaacgtttattagttgtagaacgtaaagtagtttcgttaggttacgagtactaattacgaagttggtagggtagttaggggtcgtactaccggaccgtaccggtcggggacccgtaaggggaaccgtaaccgtcggggttacccacccggtttcctcccgtaccgaccgtacccccgtacccgaacccggaaccggggtcccctaacggttccccggttccccctttaccccccggtcggtacccccctaccccgttacccctacccggaaacgtcccgtacccgtaaccccgg

SEQ ID NO: 43092 - DNA, 720 bp, Homo sapiens
  misc_feature: GYAE6OF01B5190.31.14.B03.1.454.CMB.1.raw
  modified_base (216)..(216): a, c, t, g, unknown or other
  misc_feature (216)..(216): n is a, c, g, or t
  modified_base (390)..(390): a, c, t, g, unknown or other
  misc_feature (390)..(390): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggcctggggggtccctgagactctcctgtgccatgtctgcgtctgaattcatcctcaggcactatggcatgcacgtgggccnccaggcccaggcaagggactgggagtggggtggcatttatactaatttgataggaagaattaaaaaaattttacgacagacctccggtaggaacgggcgaattcaaccatcctacccagacgaacccttaccaaccagtacgctagtactctacctaaagtagaacaatggtanaacgtagttagaaagacgaacggactaaacgtttattaagttgtacgtaacggaaaagtagtttcggtttagggttacgaagtactaatacgtaaagtgggttagggtaaggttaggggtcggaccgtacggacacccgggtcgggggacccgaaggggtaacctaacggtccggtaccaaccggttccctaccgtaccgaccgtccccgtaacccgaacccgtaaacggggtccccctaggtccccgggttccccttccccccggttagggtacccccctacccccgttaccctaacccgaaacggtaacccggtccctaacccccggg

SEQ ID NO: 43093 - DNA, 730 bp, Homo sapiens
  misc_feature: GYAE6OF01EICJ9.31.14.B03.1.454.CMB.1.raw
  modified_base (185)..(185): a, c, t, g, unknown or other
  misc_feature (185)..(185): n is a, c, g, or t
  modified_base (219)..(219): a, c, t, g, unknown or other
  misc_feature (219)..(219): n is a, c, g, or t
  modified_base (269)..(269): a, c, t, g, unknown or other
  misc_feature (269)..(269): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtcctgagctctcctgtgccatgtctgcgtctgaattcatcctnaggctactagtggcagtcgctacgtcgggtcccnccgaacggcccaggtacgaacgggtctgggaggtgggtgacttaatttanaactagtttgagtaggtaagtaaaattaaaaacgtttcgacaacgtaccgttcggtaggaacggccgtacttaccacctactaccgtaccgaacgtacccgtacccttaaccaaacctacgtaccgtcttacgtaactacctaactaaatacgaacgtagtcggtacgaagtagttaacgaagtaactagtacgtaacttaactttagttagttagtacgtaaagtaagttcggttttacggttaggttacgacgtactaatacgtaaggtggtaggtaaggtcgggtcgtactaccggtacgtcggggtacggaacgaacggtaccgtcgttaccggtaccctaccgtcctacgacgtaccgccctaaccggaaccggtccggtcccttaccggttccccggttaccccgtcccgtaccgtaccccctacccgtaccgtaaccggaacgtcccgtaccgg

SEQ ID NO: 43094 - DNA, 567 bp, Homo sapiens
  misc_feature: GYAE6OF01CRFNB.31.14.B03.1.454.CMB.1.raw
  modified_base (215)..(215): a, c, t, g, unknown or other
  misc_feature (215)..(215): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccaggccccaggcaagggactggagtgggtgcatttatacaatttgatggagaataaaaaattttacgcagactcgtgaaggccgattcaccatctccagacgacccttcaaccatacnctgtatctacaatgaacatgtgacagttagaagacacggacaacttattattgtgacgtaagtattcgttggttacgagtacatacaatgtaggatagggtggctcgacgaccgtcggggaccgagggaacacgtcggtcaccgtactcctcacgcctcctaccgaacggcccacttaccggtcccttcccccgtcggaccctacccctaccctaccaacgacgcctacccgg

SEQ ID NO: 43095 - DNA, 575 bp, Homo sapiens
  misc_feature: GYAE6OF01D9CZC.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (566)..(566): a, c, t, g, unknown or other
  misc_feature (566)..(566): n is a, c, g, or t
tcagcagtagacgtcacgaccggtgctcgatttagtgtgagtagtttgggctgagctgggtttcctcgttgctcttttaagaggtgtccaagtgtcttaggtgcacctggtggaatctggggagcgtggtccggctgggggtccctgagactctcctgtgccatgtctgcgtctgaattcatcctcaggcactatggcatgcacgtgggtccnccaggccccaggcaagggactggagtgggtgctatttanacaatttgatgganaataaaaatttcgacagactccgtgaaggccgattcaccatctccagacgacccttccaaccatacgctagtactctaccgaaatgaactatggtanactagttagaacgacacggtactaacttattattagtagacgtaaagtagttccgttggttacgaagtcaagtcaagttgtaggtactagggtgctacgacaccgtgggccagggacncgtggtcaccgtcncctacncgtcctccacgaacggccctagttccggtcctacccccgtggacccctacccgacctaccaaacncgccctacg

SEQ ID NO: 43096 - DNA, 892 bp, Homo sapiens
  misc_feature: GYAE6OF01AKRLX.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggatcgtgggggagcgtggtccggccgtggggggtccctgagactctcctgtgccatgtctgcgtctgaattcatcctcaggcactagtggcagtcgcacggtcgggtcccgccgacggccccaggaccgaagggccgtaggaggttgggtcgactaattttactaacgtaagttttgaaggttaggaaagttaaactttaaaaaagttttccgacaaggtaccgtccggtaggtaacgggaccccgtactacccgaaccctattcccgtaccgaacggtaccgtacccccttaaccgaaaccctacgttaccggtctacggttaaccttacccgtaaacccttaaagtaccgtaaactacgggttaggtaccgtaacgtagggtttaccgaaaccggtaaccgtaacggtaaccctttaaacgttttagttaacggtttgtaacggtaaccgttaaaacggttcgttttacgggttacgggttaccgtaagttaaccgtaacgttaacggtaaggttcgggtaacggaaggttccgggttaacgtccgttacccggaacggtacccgggtagggaacccggtaacggtaaacccgccgtttaccgggtacccgttaacccgtccgtaccccgtacggtaacccgttccccgaaacccgtacccgggaacccgggttccccttaccgggtaccccggttccccccgttaaccccgtccggtaaccccccttacccccgttaccgtaaaccccggtacgtaccccggtcccgtacccccgggg

SEQ ID NO: 43097 - DNA, 756 bp, Homo sapiens
  misc_feature: GYAE6OF01EJH4G.31.14.B03.1.454.CMB.1.raw
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactagtggctatgcgacgtcggtcccaccgacggcccaggccgaagggactgggagtgggngactatttanacgtaatttgagtaggaagtaaattaaaaagtttcgactagtactcgtaggacggcctatcactatctaccagaccgtaccctaccaaccagtacgtctagtactacctacaaatacgaactagtggtacaacgtagttaacgaacgacgtacgacttaaacttacgttattcggtaagacgtaaaaggttcgttacggtttcggtatacggtctaacgtacgtaagtcgggtaaggtaaggttaggggtcgtaccggtaaccggtaccggtaccgggttacggggaaccgaacggggttaaccgtaaccggttcgggttaacccgtaccccgggtttacctacccgttaccgtaaccccgtccccgaaacccgtaacccggtaacccgggtaccccgttaggttcccccggtttccccccttaccccggtaacccgaccccttacccccgtacccgtacccgaaacggtccgtccccggttaaaccccggg

SEQ ID NO: 43098 - DNA, 783 bp, Homo sapiens
  misc_feature: GYAE6OF01CBK0X.31.14.B03.1.454.CMB.1.raw
  modified_base (211)..(211): a, c, t, g, unknown or other
  misc_feature (211)..(211): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggtttcctcgttagctcttttaagaggtgtccagtgtcaggtgcacctggtggaatctggggagcgtggtccggcctgggggtccctgagactctcctgtgccatgtctgcgtctgaattcatcctcaggcactatggcatgcactgggtccnccaggtccccaggccaagggacctggagtgggtgcgtattttanaactaagtttgagtggtaagaattaaaaaacgtttccacaagacctccgtaggaacgggtcccattccaccgtaattccgtaccaacggactaccccttacaaacctagtaccgacttcgtatccctaaccggtaaatgaaactagtaggtacgaacgtagttacggaacgtaccacggaaccttaaactttagttaacgttggtacggtaaccgtaaaggttacgtttaccgggtttagggttaccgtaaagtaccgtaaattacggtaaagttggggtaggtaacgggttaacgggggtacgccttacgggaacccgtaccgggttacgggggtaccgaaacggggtaaccgacgtttacggggtccccttaaacccggttccgttacccgtacgtaacccgtcccgtaaccccgtaaaccggtaacccggggtccctaacccggttcccggttaccccgttaccccccgtacgggtacccctaccccgttacccgttacgaacccgtacgtcccgtaaccccggg

SEQ ID NO: 43099 - DNA, 739 bp, Homo sapiens
  misc_feature: GYAE6OF01A3RZ2.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccgacggccccaggcaagggctggagtgggtgctatttatactaatttgatggaagtaattaaaaaacgttttcgactagtactccggtaggaacgggtcctattaccgacctagtcctaccagactacccttaccaacatacgctagtactactacctaagtacgaactagtcgggtagaacgtaggttacgaaacgtaccgacggtactaaaccgtttattacgttggtacgtacggtaaagtcgtttcgggttagggttacgagtactaacgttacaaagttcgggtaagggtacgttaggggtcgtaccgtaccggaaccgtaccgggtcggggaccgtaagggtaacccaccggttcgggtacctacccggtccttacccgcgtaccggtacccctacccgaccggtaaaccgggtcccctaacggtttccccgggttcccccttaccccccgggtcgtaaccccccgttaccccctacccggtaaccccgaacggtacccgtccccgttaaccccgggg

SEQ ID NO: 43100 - DNA, 941 bp, Homo sapiens
  misc_feature: GYAE6OF01EN5DW.31.14.B03.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (597)..(597): a, c, t, g, unknown or other
  misc_feature (597)..(597): n is a, c, g, or t
tcagcagtagacgtcacgaccggtgctcgatttagtgtgagtagtttgggctgagctgggttttcctcgttgcttcttttaagaggtgtccagtgtcaggtgcacgtggtaggaatcggtgggggagcgtggtccggcgtcgggggtccctgagctctcctgtcgcctatgtctgcgtntagaattcatccngacggctatagtggactagtcgccgtacggtccgggtcccgaccgaccgggaccccgtaagggacgaagggtacgtgggggagggttggggtcgtactttaaagttttactaacgttaagttttggaagttaaggtaaagttaaaaaatttaaaaaacgtttccgagtaacgtaaccgttacgggtaaaggtaccgggtaccgttaacttaccgactaacttcccgtaacgacgtaaccgtaccccttaaccgaaactacgtacctacgtacgtaactacctaaactaagtaacgaacgtaggtacgggtaactagtaacgttaacggaacgaccgtaaacgtactttaaactttgttaacggtcggtaacgtaaaggttaacgttcggtttcgttaacgggtanacgtaacgtaacgtaagtaggttacggtaggtaacggttcggggtactacccgggtacgtaacccggcgggtaaccggggtaacgtaaccggggtaacccgttaggttacccgggttaaccccctacggtttcccccgttaacgtaaccccgggtacccgtaccccggtaaaacccccgggttaaaaccggggtaccccccggtttaacccgtaccccgggggttttccccctaacccccccgggttttaccccccggaccggttaaaccccccccccggttcctaacccccggggtaaaacccggaccgggtttcccccgaaaacccgggtttcccccccggg

SEQ ID NO: 43101 - DNA, 771 bp, Homo sapiens
  misc_feature: GYAE6OF01DBHJ2.31.14.B03.1.454.CMB.1.raw
  modified_base (216)..(216): a, c, t, g, unknown or other
  misc_feature (216)..(216): n is a, c, g, or t
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtccggcctgggggtccctgagactctcctgtgccatgtctgcgtctgaattcatcctcaggcactatggcatgctacgtcggggtcccnccgacggcccccaggccgaaggggctgggaggtgggtggctaattttanacgtaaattttggatagggtaaggtaaattaaaaaaagtttttccggactaaggtaccgtaccgtaggaacgggtcccgaatttaccgaacctatcctaccaggtaaccgtacccctttacccaacctaacttaccggacttcgttaacttacctacccaaaattcggaaacctaagttagggtacgaaaccgtaggtttaacggaaacgtaaccgaccgggtactaaaccgttatttagttacgttaggtacgtaaagttagtttaccggtttaggttacgtagtactacgtacgaagttggtagaaggttacggggcgtacgtcggaaccgtaccggtacggggacgtaacgggaaaccgtacgtacgggtcctaacccggttcttacccgacgtaccgcctaccccgaaccgaacgggtccccttacggtccggttcccccgttcccccgtacgggacccctaccccgttacccgtaccaaaccggtcgcccgtaaccccggg

SEQ ID NO: 43102 - DNA, 735 bp, Homo sapiens
  misc_feature: GYAE6OF01C7IUJ.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccgccgacggccccgaggacgaagggactgggaggtgggtacggtactaattttatacgtaagttttagagtaggtaaagtaaatttaaaaaacgttttaccgactaacgtaccgtaccggtaaggaacgggaccgtacttaccaacctatccgtaccaacgaccgtaccccttaccaacctactacgctcgtactactacaaatacgtaacagtaggtagacgtaggtagaagacgacggacttaattatttacgtagtacgaaggtaagtagtttacgttggtacgagtctattacagtggtaggtaaggttgggtacgtaccgtaccggtaccgaccgggtcggggaaccgaacgggaacttaccggtcggtaccgtaccccgttacctacccgtaccgaaccgtcccgtacccgaacccgacccgggtacccctacggttccccggtttcccctacccccggtccgaccccgtccccccgttaacgacccgaaacggtcccgtacccgtaacccggg

SEQ ID NO: 43103 - DNA, 1007 bp, Homo sapiens
  misc_feature: GYAE6OF01CG0PU.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtggggagcgtggtccggccgtgggggtccctgagactctcctgtgccatgtctgcgtctgtaattcatcctcaggcactatggcatgcacgtcgggtcccgccgacggcccccaggaccgaaggggactgggagttggggtgtactaattttataactaagtttgaagtaggtaagtaaaatttaaaaaaactttttaccgactaacggtaccgttccggtaggtaaacggggacccgtatttaccaacccgtacgttccctacccgtaacggtaacccgttaaccccctttaaccctaaaacccgaacgtttaaacccgtccgtttaggttaaccttacccttaacccgtaaaaacgttacggtaaaaccgtaggtttacgggggttaaccggtaaacgtttaacgggtttaacggaaaccgggtaaaccgtaaacccggggtaaacctttaaaacgtttttaacttttaaagggtttacggttaacggtaaacggttaaaacggtttaacgttttaccggggttttaggttttcccggaaaggttaccttaacgttacccgttaaaggttcggggttagggttaaagggttcgggggtttacggtaccccggttaccggtaacccggttacccgggggttaacggggggtacccccggaaacgggggttaaacccgtacccgggtttacggggttacccccgtaaccccggttttacccgtaccccgttccgtaaaccccggttccccccgtaaccccggtaaccgggaaaccccggggttcccccgtaacccggtttccccggttcccccgtttacccccccggccggtacccctacccccggttaccccttaaccggaaacccggtccccgtaacccgtccccggg

SEQ ID NO: 43104 - DNA, 774 bp, Homo sapiens
  misc_feature: GYAE6OF01DAY9M.31.14.B03.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactatggcatgcacgtgggccncacggccccaggccaaagggctggagtgggtgactagtttanactaatttgataggaagtaattaaaaaaattttcgacaagtaccgtccgtaggaacgggaccgtattccgaacctattacctaccgaacgtaccgtaacccctttaccaaaccgtacttaaccgcttacgtactacctaacctaaaagtcgaaactagtggtacgaactagttagaaacgacgtacggactaaacgtttattacgttgtacgacgtaaaatgtttcggttggttaccgagtctaagtctaaagtcggtaggtaagttacggggtcgtaccgttccggaaccggaccgttcgggggaacccaaggggtaaaccctaccgggttcggtaaccctaaccccggttcctacccgtaccgaaccggtccccgttaaccccgaaaccggaaccccggggttcccctaaaccggtttccccgggttcccccgtttaccccccccggagggttacccccctacccccgtttacccgaaccccgtaaaggtaaccccggtccccgtaacccccgggg

SEQ ID NO: 43105 - DNA, 672 bp, Homo sapiens
  misc_feature: GYAE6OF01DC1IL.31.14.B03.1.454.CMB.1.raw
tcagcagtagacgtcacgaccggtgctcgatttagtgtgagtagtttgggctgagctgggttttcctcgttgctctttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccaggcccccaggccaagggctgggagtgggtgctatttatacaatttgatggaataaattaaaaaattttcgacaagtactaccggtagaacgggccgtaattccacctaatcctaccagaccgacccttccaaccatacgctgtactcctaccaaatcgaaactagtggtacgacgtaagttacggaaacgaccgtacggaacttaaacgtttatttaagttggtacgaacggtaaagtgttttaccggtttgggttacgagtctaagttacgtaagttggtaggtaagttaggggtcgccgttacggaccgtaccgggtcggggacccgtaaggggaacctacgtcgtacctaccgttcctacctcgaccgtccctaccgaaccgacggccctagttcccggtcccttcccccggtgacccctaccccgttccaccgaacgcgcccgtacccgg

SEQ ID NO: 43106 - DNA, 835 bp, Homo sapiens
  misc_feature: GYAE6OF01EI0LP.31.14.B03.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctgaggcactagtggcatcgcacgtcgggtcccnccgacgggccccgagggaccgaagggggtacgtggggaggttggggtcggtacttaagttttaataacgttaaagttttggaagttaggggtaaagtaaaaatttaaaaaaaacgtttttaccgacgtaacggtaaccgttacccggtagggaaaccgggggtcccgttaattaccgaaccctattcccgtaacccgaaggtaacccggtaaccccctttacccgaaaaccctacgtaaccgtcgttacgttaactaccttaaccaaagtacgtaactagtcgggtacgtaacgtagttagaaacgacgaaccggacttaaactttattagttaggtacgtaacgtaaagttagtttacggtttaggttacggagtacgtatacgtaaggttcgggtagggttaacggtaggggtcgtaccgtaccgtaaccggtacccgggtacggggaccgtaacgggtaaccgtacgtccgggttaccctaccggttcctacccgtaccgaccggtccccgtacccgtaaacccggaccggccccttaccggttcccggttcccccttccccgcggtaccccctacccgttacccaccgaacgtcccgacccgtacccggg

SEQ ID NO: 43107 - DNA, 777 bp, Homo sapiens
  misc_feature: GYAE6OF01COKIK.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcggggtcccnccgacggcccccaggcaaggggactgggagtgggtgctatttatacaatttgatggaagaaattaaaaatttacgcagtactccgtaggaaggccgattcaccatctcagacaccttaccaactatacgctgtactcctacaaatgaactagtggtagacgtaggttagaacgtaacgaccggtactaaacgttttattaacgttaggtacggaacggtaaaggttacgttttaccgggtttgggtttaccgagttacctaagttaccgtaaagtttgggtaagggttaaggttaacgggggtcgggtaccttaccgggaacccgtacccgggttcggggggaacccgtaagggggaaccctaccgggttaccggtacccgtaacccgttttcccgacccttaccgacccggtacccccttacccccggaaacccggtaaacccggggtcccccgttacggtttaccccgggttccccctttccccccccggtgggacccccccttacccccgttaccccgtacccgaaaccggtcccgaccccggttaacccccggg

SEQ ID NO: 43108 - DNA, 912 bp, Homo sapiens
  misc_feature: GYAE6OF01DFS82.31.14.B03.1.454.CMB.1.raw
  modified_base (167)..(167): a, c, t, g, unknown or other
  misc_feature (167)..(167): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggcgtgggggtcctgagctctcctgtgccatgtcngcgtctagaacttcatcctacgaggccaacttagtcggacctagtgaccgtaccggtcggggtcccccgcccgaaccggggcccccgtaaaggggacccggaaagggggtaccgttgggggaaggggtttcgggggtacggtaacctttaaaggtttttaaaacaaaccgtttaaaggttttaggaaacggttaaggggtaaaacgttaaaaaactttttaaaaaaaaacggttttcggaacccgtaaggttaacccgttaccgggttaacgggaaaccgggtaccgttaactttacccgaacctacgttacccgaccgtaacgtaacccgtaacccctttaacccgaaacctacgtacccgtcgttacgtaacgttaacctaacgtaaacgtaagaaaccgtaggttacggtaacgaacgtttaaggtaacgaacggtaaccgtaacgtaacttaaacgtttaatttacggtaacggttacggtaaacgtaaagtttcgttttacgggttaggtaccgagtactacgtaagttaaggtggtaagggtaggtcgggtaggacctaccggacgaccgggtagggaccgaacggtacgtacccggtgttacccgtacctttccacccgtaccgaccgttccccaaccggaacccggtaccgtaccccgtagttcccccgggtcccccttacccgaacccggtcccctacccctaacccgtaccggaaccgtccgccccggttaccgg

SEQ ID NO: 43109 - DNA, 740 bp, Homo sapiens
  misc_feature: GYAE6OF01EQ4QC.31.14.B03.1.454.CMB.1.raw
  modified_base (194)..(194): a, c, t, g, unknown or other
  misc_feature (194)..(194): n is a, c, g, or t
  modified_base (719)..(719): a, c, t, g, unknown or other
  misc_feature (719)..(719): n is a, c, g, or t
  modified_base (729)..(729): a, c, t, g, unknown or other
  misc_feature (729)..(729): n is a, c, g, or t
tcagcagtagacgtcacgaccggtgctcgatttagtgtgagtagtttgggctgagctgggtttcctcgttgcttcttttaagaggtgtccagtgtcaggtgcaccgtggtggaatcgtggggagcgtggtccggcgtgggggtcctgagctctcctgtcgcctatcgtctggcgtactagaacttcacgttccncgaggtcctaattagcggtactagtcggaccgtacggtcggggtacccaccggaaccggaccccgtaaggacggaagggtacgtgggtacgggtgggtacgacttaagtttacaagttaagttggaagttaggaaagttaaaactttaaaaaacgttccgacgtaacgtacgttaccggtaaggaaccgggtcctaacttccgaacctacgtcgtacccgaagtacccgtacccttaaccgaactacgtacgtacttacgtactacctaaacgtaatacgaaacgtagtacggtataacgtaggtacgaacgacgtacgtacttaattacgtacgtagaacggtaacgtaacgttcggttacgggttcgtaagacgtactaacgtagtaggtacgtaggaggttcgtcgaacctcggtacgaccggtaggaccgtaagggtctacggtcgaaccttccgtcgacaccgtcgacccgtaaccgaccgtacggctaccggttccggaccttcccgacgtcctacccncgtacgaacngtccctacggg

SEQ ID NO: 43110 - DNA, 743 bp, Homo sapiens
  misc_feature: GYAE6OF01DRPT7.31.14.B03.1.454.CMB.1.raw
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgccacctggtggaatctggggagcgtggtccggcctgggggtccctgagactctcctgtgccatgtctgcgtctgaattcatcctnaggcactatggcatgcacgtcgggtccnccagggcccccaggtcaagggctgggagtgggtgctagttttanactaatttgataggtaagtaattaaaaaattttcgacagactccggtagaacggtctattcaccatctacagacacccttaccaacctatacgcttcgtaactcgtaccaaatcgaaactagtaggtagaactagttacggaacgacgacggtactaactttatttacgttacgtagaacgtaaagtcgtttacggttggttacgagtactaagtacgtaagttgggttaggtaacgtttagggtcggtaccttaccggaacctacccgggttacgggggaacccgtaacggggtaaacctaccggttcggggttacccaacccgggtttaccgtacccgttacgtaacccgtaccccgtaaccccgaaacccgggaaacccgggtccccttacgggttccccggtttcccccgtttaccccccgtcggttaaccccctaccccgttacccctacccgtaaacggtccgtccccgtaaccccggg

SEQ ID NO: 43111 - DNA, 884 bp, Homo sapiens
  misc_feature: GYAE6OF01ECBGF.31.14.B03.1.454.CMB.1.raw
  modified_base (872)..(872): a, c, t, g, unknown or other
  misc_feature (872)..(872): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtggggggtccctgagactctctgtgccatgtctgcgtctgaattcatcctacgaggcacttagtggcctagtcgcctacggttcggggtccccgcccgacgggcccccgaaggggaccgaaaggggaccgttaggggaggggttgggggtcggacctttaagtttttaacgtaaacgttaaagtttttaggaagttaagggtaaagttaaaaatttaaaaaaacgtttttacgaacgtacggtaaccgttaccggtaagggaacgggtacccgtaactttaccaacctacgtaccctaccgaacggtacccgtaaccccttacccaaacctacgtaccgtacgttacgttaactccgtaacctaaaagtacgaaactagtagggtacgaacgtaggtaacgaacgtaacgaccggtaacttaactttagtttagttggtaacgtaacggttaaagttacggtttacgggtttaggttaacgagtaacctaagttacgtaaggttacgggtacggggtaagggttacggggttgtacccggttaaccggaaccggttacccgggtacgggggaacccggtaaacgggtaacccggtaccggttcgggtaccccgttaacccggttcctaccccgtaacgaccgtccccgttaacccgaaccggtaccgggtacccctaggttaccccgttccccgttccccgtacgtacccctacccgtccctaaacggacggtccncccgtacccggg

SEQ ID NO: 43112 - DNA, 692 bp, Homo sapiens
  misc_feature: GYAE6OF01E46NN.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcggggtcccgccaggcccccagggacgaaaggggactgggaggtgggtggctatttaataactaatttgatggagaataaaaaattttacgcagactccgtagaagggccgattcaccatctccagacgacccttccaaccatacgctgtatcctaccaaatgaacatggtgacagttgaagacacggacaacttattattgtagacgaaggtatttcggttggttacgagtcgaatcaatagtaggacgtagggtcggcgtacgaccgtaccgtacgggggaccaaggggaacctacgtacgggtacccgtaccccgttcctacccgtccaccggtacccctacccgtaaacccgaaaccgggggtcccccaacgttaccccggggttcccccttttacccccccccgtacggggttacccccaaacccccccgtttccccgtaacccccgaaacggtacccggacccgttaaaccccccggg

SEQ ID NO: 43113 - DNA, 902 bp, Homo sapiens
  misc_feature: GYAE6OF01A063P.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccnccgacggccccagggcaaggggactgggaggttgggtggactaattttataactaattttgagtaggtaagtaaattaaaaaagttttacgacaagtaccgtccggtaggaacggggccgtaattccgacctacttcctaccgaacggtaaccgtaacccctttacccaaaaccctaacttaacccggtacttacgttaactacccttaaccctaaaatacggtaaacctaagttacgggtacgtaacgtaacggtttaaggaaacgtaaccgtaaaccgggtaaccttaaaaccgttttaaagtttaacgtttagggttaacggtaaccggttaaaaggttacggtttttacggggtttacgggtttaccggaacggtaccgtaattaaccgttaaaggttacggggttaggggtaaaggttacgggggttacgggtacccgtaccgggtaacccgtaaccccggggttacggggggaacccgtaaacgggggtaaccctaaccgggttacgggttacccgtacccggttcccgtacccctaccgaccggtaccccctacccgaaaccccggaaacccggggtcccctaacgggttccccgggtttcccccgttaccccccgtggaccccccttacccccgtacccgttaacccgaaacggtccggtaccccgtaacccgggg

SEQ ID NO: 43114 - DNA, 751 bp, Homo sapiens
  misc_feature: GYAE6OF01C02EK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcgaggcactatggcatgcacgtcgggccgccgacggcccaggacgaagggctgggaggtgggtgactagtttatactaatttgaagtaggaagtaaattaaaaaagtttcgacaacgtacgtccggtaggaacgggtcctaattaccaactactcctacgagaccgtacccttaccaactactacgctagtactactacaaagtgaactagtggagtaactagtagaacgaactacgacttaactttatagttacggtagaacggtaaagttcgtttacggtttacggttaacgagtactaacgtacgtaaagtcgggttaagggaggttacggggtgtaccgttacggaacccgtaccgggtcgggggtaacccaacgggggtaacctaaccgggtcggtaaccccgtccggttaccttaccggtaccgaccgtacccctaaaccccggaaccggtaaacccggggtacccctacgggttacccccggtttcccctaccccccggtacggtccccctaacccccggtcctaacccggaacgtcccgaccccgttaacccggg

SEQ ID NO: 43115 - DNA, 611 bp, Homo sapiens
  misc_feature: GYAE6OF01A9A84.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccaggccccaggcaagggctgggagtgggtggctatttatacaatttgatggaagaataaaaaattttacgcagactccgtgaaggccattcacatctccagacgacccttccaaccatacgctgtatctacaaatgaacatggtgactagtagaagacacggactaacttattattgtagtacgaaagtattcggttggttcgagcatacaatggtaggagtagggtgctacgacaccgtggggaccagggaacacgtgtacctacctttctccctacgacgccctacccaacccgtaaaccggggtcccctaagttccccggttccccgtttccccccgtcggacccctaacccccgttccccgaacccaaacggtccgtacccgtaccccgg

SEQ ID NO: 43116 - DNA, 814 bp, Homo sapiens
  misc_feature: GYAE6OF01DUADN.31.14.B03.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctnaggcactatggcatgcacgtcgggtcccnccgacggccccagggacgaaaggggtctgggagtgggtcgactatttaanaacttaagtttgaagtaggaaagtaaaattaaaaaagttttcgactaagtaccgtccggtaaggaacgggtacctacgttaccaacctacttacccgtaccgaacgtacccgtaacccccttaacccaaaccctaagtaccggtcttaacgttaactaccctaaaccaaaagttcgaaaaccgtagttaggtacgtaacgtaaggttaaaggaaacgtacgtaaaccggtactttaaaacgttatttaacggtaggtaacgtaacgtaaaggttacttttccgggttaggttacgacgtacctaagttaacaaggttgggttaaggaggttagggtcgtacggtacgaaccggtccggtacggggacgtaacggggaactccggtacggtacccttaccgttcctaccgacccgtacgtccccctaacccggaaccgggtaacccggtaccccgttaccggtcccccggttcccccgtttacccccggtcccgtacccccctacccgtacccccgttaacgaccgacccgccccgttaacccgggg

SEQ ID NO: 43117 - DNA, 797 bp, Homo sapiens
  misc_feature: GYAE6OF01BGHY6.31.14.B03.1.454.CMB.1.raw
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgccacgtcgggtccnccgacggccccaggcgaagggactgggaggtgggtgctatttanactatttgatggaataaattaaaaattttacgacaagaccgtaccggtaggaacgggccgtattaccaccgtactccgtaccaagtaccgtaccccttacccaaaccctacgtaccgtcgttacgtacttacctaacccgaaatacgaaacgtagtcgggtacgaacgtaggttacgaaacggaacgaaccggtaaccttaaactttattagtttaggtaggtaacggtaaagttacgtttcgggtttacgggttacgtaacggtataactaacgtaagttgggtaagggtaggttaacgggggttcggtaccctacggaacccgtccgggtacgggggtacccgtaacgggggtaaccctacgggtttacggtaccctacccggttccctaccgtaccgacccggtacccctacccgtaacccggaacccggggtacccctaccggtttccccgggttcccccctttcccccggtaccggaccccctaacccccgttcccgtaacccgaacggtaccgccccgttaccccggg

SEQ ID NO: 43118 - DNA, 683 bp, Homo sapiens
  misc_feature: GYAE6OF01C45XR.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtggggaggcgtggtccggccgtgggggtccctgagactctcctgtgccatgtctgcgtctgaattcatcctcaggcactatggcatgcacgtgggtcccgccacggcccccaggccgaaagggactgggaggtgggtggctagtttatactaatttgagtaggaagtaaattaaaaaatttcgacaagtactaccggtagaacgggcctattaccaccatcctcacgacgaccccttacaaccatacgctagtactccgtactaaatcgaacagtggtagaacgtagttagaacgtaacgacggtactaaactttagttaagttgtacggaacggttaaagtcgttttacgggtttgggttaccgaggtactaatacgtaagttggtacgggtaagttaggggcgtccgttacggaccgtaccgggtggggacctaagggaacctacgtcggtccacccgttcctaccgtacgacctccgtacccgacccggaacggtccccctaggttccccgtcccttccccgtcggcccctacccctactacccgaaaggtcccgacctacccgg

SEQ ID NO: 43119 - DNA, 575 bp, Homo sapiens
  misc_feature: GYAE6OF01ETQLP.31.14.B03.1.454.CMB.1.raw
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
  modified_base (422)..(422): a, c, t, g, unknown or other
  misc_feature (422)..(422): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggccccaggcaagggactggagtgggtgctagtttanactaatttgatggaagtaataaaaaattttacgacagactccgtagaacggccgtattcaccatctaccagacgacccttaccaaccatacgctgtatctacaaatgaactagtggtanactagttagaacgacacggactaacttattacttagtagtacgaaagtnttcggttagttcgagcatctaatgtagtagtagggtgtctcgacncgtgggccaagggactacgtgtcaccgtctcncacgcctccaaccgacggccctagtcccggtcccttccccgnggccctaccccgtcctaccgagcgccgtacccgg

SEQ ID NO: 43120 - DNA, 869 bp, Homo sapiens
  misc_feature: GYAE6OF01DPF6M.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagctctcctgtcgccatgtctgcgtctagattcatcctcaggccactagtgcatgctacggtcgggtcccgccacggcccgaggacgaagggtctggggtaggtcggggtgtacttaagtttaactacgtagttttaggagtaagggtaagttaaaaatttaaaaaacgttttccgacgtaaccggtaaccgtacccggtaggaaaccggggtaccctacttaccaccgtacttccgtaccgaacggtacccgtacccccttaaccaacccgttaacgtacgtaccgttacttactaaccctaaccgtaaagttaacgtaaacgtaggtttaggtaacgttaaccggtaaggtttaacggaaacggtaaccgtacccggtaaactttaaacgttttaagtttagttaggtaaccggtaacggtaaacggttttggtttaccggggtttaggttaccggaagtactaacgttaacggtagttacgggtacgggtagggttacggggtcgtacccgtacggacgtcccggggtaggggaaccgtaacgggtaacgtccgggttcggtaccctaccgtacccgttccaacgcccggtaccctaacccgggacccgtaaccgggttaccccttacggtttccccggttaccccccttccccggaccggttccccccctaacgtttaccccgaaccgaacggttaacccggcgttaaccccggg

SEQ ID NO: 43121 - DNA, 919 bp, Homo sapiens
  misc_feature: GYAE6OF01DYE2Y.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcaccgtggtggaatcgtggggagcgtggtccggcgtgggggtcctgagctctcctgtcgccagtgtctgccgttctagtaactttcacttccctacgaaggtctaacgttagtcggctagtcgacctacggttccggggcccacccgaacgggcccccgaagggacggtaaacggggtacgtggggtaggttcgggtcggacttaatttttaactaacgttaagttttaggaagttaggggtaaaacttaaaaacgtttaaaaaaagttttccgaacgtaacggtaaccgtaccggtaacggaacgggtacctaacttacccggacctactacctaccgaacgtacccgtaaccccttaacccaaacgtaccgttacgtaccgttacgtaactacccgtaaaccaaagtaccgtaactagggttacggtacgtaacgtaggttaacggaacgtacgtaaccgtaacttaaactttgtttaacgtaggtacggaacgttaacggtttggttaccggttagttaccgacgtacgttaacttaacggtaagttagggtaacggtagggtttaacggggtgtaaccccgtacggtaaccgtacccggggtacgggtaacccgtaaagggtacccttaacggtcccggttaacctacccggttaccttacccggtaccgaccggttaccccaacccggtaaccggtacccgggtccccttaccggttcccccgggttacccccctttacccggaacccggttcccccctaaacccccggttccgtaaacccgaaaccggggtccgttcccccgtaacggggg

SEQ ID NO: 43122 - DNA, 653 bp, Homo sapiens
  misc_feature: GYAE6OF01BJ6SL.31.14.B03.1.454.CMB.1.raw
  modified_base (268)..(268): a, c, t, g, unknown or other
  misc_feature (268)..(268): n is a, c, g, or t
  modified_base (401)..(401): a, c, t, g, unknown or other
  misc_feature (401)..(401): n is a, c, g, or t
  modified_base (507)..(507): a, c, t, g, unknown or other
  misc_feature (507)..(507): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagctctcctgtgccatgtctgcgtctgattcatcctcaggctactagtggcatgcacgtcggggtcccgccgacggcccccagggccgaaggggactgggagtgggtgactatttanactaatttgagtggaagtaattaaaaaagttttcgactagactaccgtaggtaacgggccgtattcaacctactctccagacgtacccttccaaaccatacgctagtactctacctaaatgaactatcggtanacgtagttacgaagacacggtactaactttagttattaggtagacgtaaacgttgtttccggttagggttaccgaggtactagtactaggtgtagggtagtagggngtactcgacgtccggngggtaccgaaggaacgtacgtacggtctaaccggtcctcgtaccagtcccctacgaaccgtacggtccctagttcccgtcccttccccgtggacccctacccgtacctacccacgtcgtcccgtacccgg

SEQ ID NO: 43123 - DNA, 701 bp, Homo sapiens
  misc_feature: GYAE6OF01EHPWP.31.14.B03.1.454.CMB.1.raw
  modified_base (254)..(254): a, c, t, g, unknown or other
  misc_feature (254)..(254): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggctgagctgggtttttcctcgttgctcttttaagaggtgtccagtgtcaggtgcactggtggaatctgggggaggcgtggtccggcctggggggtccctgagactctcctgtgccatgtctgcgtctgaattcatcctcaggcactatggcatgcactgggtcccgccacggccccaggcaagggctggagtgggtgctatttanacaatttgatggagataaaaaatttcgcagactcggtgaagggccattcaccatctcaagtacgcccttaccaaccataccgcttagctactaactcgaaaactagacgtagacgtagtaacgagtacgaacggaccaacggttaattaatttagttagtaccggtaagacgtttaacggttggtttacggtagggtacgaaagtcctaanaacggttagtagttaggggtaggtccgggttacggacctaacccggtacgggacccgtaggggggaaacccagggttaaccggtcctaccgggttaccctacccgttaccgtaaccgtccctaccccggaacccgtaaacccgggccctaacgggtccccggttaccctttccccccgggtcgtacccccctaccggcccctaacccctaaccgtcggaaaccgcccgtacccggg

SEQ ID NO: 43124 - DNA, 676 bp, Homo sapiens
  misc_feature: GYAE6OF01EYZRO.31.14.B03.1.454.CMB.1.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatcgcacgtgggtccgccaggcccccaggcgaagggactggagttgggngctatttanactatttgatagganaataaaaatttcgacagactcgngaggcctatcacatcncagacaccctcaactnacgtctgtatctaccaatnaacagtagtgactaggtagaacgacgacggtactaacgttattagttgtagacgtaagtagtttcgttcggttacgagtacactacgtaagtggtggtagtagggtgtccgtacggaccgtaccgggtcggggacccgaagggaaccctaccggtacgggttcccaacccggttccctcccgtaccgacgtcccccgtacccgaaacccggtaaccggggcccccttaaagggtcccccggtttaccccctttccccccgggtacgaaccccccttacccccgttaccccgtaaaccccgaagggaccccgtcccgtaaacccccggg

SEQ ID NO: 43125 - DNA, 536 bp, Homo sapiens
  misc_feature: GYAE6OF01BWQKF.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (360)..(360): a, c, t, g, unknown or other
  misc_feature (360)..(360): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggctggagtgggtgctatttanacaatttgatggaagaataaaaaattttacgacagactcgtggaagggccgattccaccatctccagacacccttccaaccatacgctgtatctaccaaatcgaacntggtgacagttgaagacacgactaattattattgtagacgtaaagtagttcgttggttacgagacatacaagtgtggtagtagggtgctcgacacgtgggcagggacngtgtcncgtcnctcngccncacgacgccatccggtcctcccctgccctaccctccaccagcgctaccg

SEQ ID NO: 43126 - DNA, 950 bp, Homo sapiens
  misc_feature: GYAE6OF01BC82A.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagcgtgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcactgggtccnccaggccccaggcaagggactggagtggggtgctatttagtactaattttgagtaggaagtaaattaaaaaacgtttttacggactaacggtaccgttacccggttaggaaaacggggtccccgaattttcccaacctactttccctccctaaacggaaccggtaaccccccttttacccaaaaccctacgttaacccgtctttaacgtactacccttaacccaaaagttacgaaactacgtgggttacaaccggtagttagaaacgaccgtacgggtaaccttaacttttaatttacgttggtaacggtaacggtaaaggttacgttttaccgggtttacgggttttaacggaccggtactaacgtttaccgtaaagggtttcgggttaaggggtaacgggtttacgggggtacgggttacccggtaacccgggtaaacccgggttaacccggggttacgggggggaaccccggtaaagggggaaccccgttaaccgggttccggggtttaccccgtaaaccccgggtttcccgttaacccccgttccgaacccggtaccccccgtacccccggtaaccccggaaacccgggggttaccccccgtaacggtttcccccggggtttaacccccccgttttccccccccgggtgggttaaccccccccttaaccccggttaccccccgttaaacccggaaacccgttaccgggtaccccccttaaaccccgggg

SEQ ID NO: 43127 - DNA, 798 bp, Homo sapiens
  misc_feature: GYAE6OF01CR547.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcttggggggtccctgagactctcctgtgccatgtctgcgtctgaattcatcctcaggcactagtggcatgcacgtcgggtcccgccgacggcccccagggacgaaaggggcgtgggaggtcgggtggctaatttataactaatttgagtaggaagtaattaaaaaagttttacgactagtacctccggtaggaacgggacctattaccgacctactctaccagtaccgtacccttaccaaccactaccgctagtacttacctaccaaagtcgaaactagttagggtacgaacgtaaggttaggaaacgtaaccgaacgggtaactaaacgttttatttaagttggttagaacggtaaagttacgtttcggtttagggttacgtaagcctaataacgtaagttcgggtaaggtacggtaggggttcgaccgtacgaaccgaccgggttaggggcccgtaaaggggtaaccgtaacggttcgggtaccctaacccgttccgttacccgtaccgaccggtacccctacccgaacccgggtaaaccgggtacccccttacgggtttaccccgggttcccccctttaccccccggtaccggtaccccccttaacccccgtaccccgttaacccggaaacccggtccggtaccccgttaacccccgggg

SEQ ID NO: 43128 - DNA, 853 bp, Homo sapiens
  misc_feature: GYAE6OF01BRSVT.31.14.B03.1.454.CMB.1.raw
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatcgtgggggagcgtggtccggccgtggggggtccctgagactctcctgtgccatgtctgcgtctgaattcatcctcaggcactatggcagtgcacgtcggggtcccncgacggccccagggaccaaggggactgggaggtgggtcgctatttanacaatttgatggaataattaaaaattcganagtactcgtagaacggtcctatccacatccgtaccaggtaccaccccttacaaaacctagtaacgtctagttaactcctaaccgtaaaatcgtaaacagttgggtacgaacgttaaggttaagaaacggaccgtaacggtaccttaaatttaagtttagtttaggaacgtaaccgtaaaggttacggttttacggttacgggtttcgtacgtacgtaactacgtaaggttagggttagggtaaagggtttacggggtacgggtacccggttaaccggaacccggtaaccccggggttacggggaacccgggtaaacgggtaaacccggtaaccgggttccgggttaaccccgggttaccccttacccggttaaccccgttccgaacccggttacccccgttaacccccggaaacccggtaacccggggacccccgttaaccggtttcccccgggttccccctttcccccccgggaaaaacccggtcccccgttaaaccccccgttaccccggtaaaccccgtaaaccgggtaacccgtaccccggtaaccccgggg

SEQ ID NO: 43129 - DNA, 796 bp, Homo sapiens
  misc_feature: GYAE6OF01BJ9X0.31.14.B03.1.454.CMB.1.raw
  modified_base (301)..(301): a, c, t, g, unknown or other
  misc_feature (301)..(301): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggacatgcacgtgggtcccgccacgggccccagggacaaggggactgggaggtgggtggctatttatactaagtttgagtggaagtaattaaaaattttcganagactcggtaggacgggcctattcaccatcctaccagtacgtacccttaccaacctactacgcttagtactacctaccaaatgaaactagtggtacaacgtaggttagaacggacgaaccgggtacttaaacgtttaatttacgttaggtacgtaacggtaaaggttacgttttccgggtttaagggttaccggtagtacctaacgttacgtaaggtttgggtaaggggttaacggttagggggttaccggtccgttaccgggtaacccggtaacccggggttacgggggaaccccgtaaagggggtaaccctaccgggttaccgggttacccgtaacccggttccctacccgttaccgaccgttcccccgtacccgaaaccccgggtaacccggggccccttaaccggttccccgggttccccctttaccccccggacggtaccccctacccccgtacccgtaaccccgaacggtcccgtccccgtaacccggg

SEQ ID NO: 43130 - DNA, 812 bp, Homo sapiens
  misc_feature: GYAE6OF01C3EBT.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcacgtgggtccnccaggccccaggcaagggctggagtgggtggctatttatactaatttgataggaagtaattaaaaaattttacgacaagactaccggtagaacgggccgtattacacctatcctccagaacgtacccttaccaacctatacgctagtactcctacaaatacgaactagtaggtagacgtagttagaacgtacgacggtactaaacgtttaatttacgttagttacggtaacgaaaggttacgttttaccgggtttacgggtttacggtaacgtacctaaacgttaaccgttaaaggtttggtaaggggtaaggttaagggggtaccggtccgttaaccgggaacccgtacccgggttacggggggaacccgaacgggggtaaacctaccggttcgggttaccctaacccgggttcccttcccgtacccgtacccggtaccccgtaccccgaaacccgggaaaccggggtacccccgtaaccggtttccccggggtttcccccctttccccccccgggttaccgggtacccccctaaccccccggtttaccccttacccccggtaaaacggcccggtaacccccgttaaccccggggg

SEQ ID NO: 43131 - DNA, 851 bp, Homo sapiens
  misc_feature: GYAE6OF01EWHZK.31.14.B03.1.454.CMB.1.raw
  modified_base (75)..(75): a, c, t, g, unknown or other
  misc_feature (75)..(75): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctnttttaagaggtgtccagtgtcaggtgcacctggtggaatcgtgggggagcgtggtccggcgtggggggtccctgagactctctgtgccatgtctgcgtctgaattcatcctcaggcacttanggcatgctacgtgggtcccnccgaacggcccccagggacgaagggaccgtggggaggtgggtggacttaatttacgtaactaagttttgaagtagggtaaagtaaaattaaaaaaagttttccgactaacgaccttaccggtaggaacggtaccggtacttaccaacctagttcctaccgaagtacccgtaccccttaccaaaccctagttacccgtacgttacgtaactaccttaacgtaaaactacgtaaacgtaagttgggtaacgtaacgtaggttacggaaacggtaacggtaaccggtaacgttaaactttaaagtttacgttacggtaccggttaagtaaacgttaacgttttccgggttaggttacgaggtaactagtaacgtaagtcgggttagtaaggtacgggttagccgtaacggtacccgtacggtacgggggtaaccgaacgggtaaacctacgggttaccgtacccgtaccgttaccccgtccgttacccgaacgtacccccgttacccggaaaccgtaacccggggtaccccttaacccggggttccccgtttaccccccgttacccccggtcggtaaccccccttacccccgttacccgtaaacccgggaacgaacccggttcccttaaccccgggg

SEQ ID NO: 43132 - DNA, 793 bp, Homo sapiens
  misc_feature: GYAE6OF01AFHUJ.31.14.B03.1.454.CMB.1.raw
  modified_base (560)..(560): a, c, t, g, unknown or other
  misc_feature (560)..(560): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcgtggggggtccctgagactcgtcctgtgccatgtctgcgtctgtaattcatccgtcaggccactagtggcatgcacgtgggtcccgccacgggcccccaggacgaagggactggaggtgggtggctatttatactaatttgagtaggtaacgtaaattaaaaaagttttcgacgagtaacgttccggtaggaacggccgtaattccaccacgttccaccgaaggtaccgtaccccttaccaaacctactaccgacgtagttaacctaccgtaacctaaagtacgtaaacgaagttcggaacgtaaccgaagtttaaggaacgaacgtacggaacttaactttagtaatttcggaagacgttaaagtacgtttcggtttaggtacgacgtacctaagtacgtaagtcgtaagggtagttacgggngtaccgttaccgaccggtaccgggtacgggacccgggtaaggtacccgtacgttacgggttacccgacccgtttaccgtccctaacggcccgtacccgttaaccccggaacccggttaaaccggtccccgaccgggtttaccccggttcccccggttacccccgttaccgaccccccgttaaccccgttacccccgttaaaccaacggggtcccccgtacgtaacccccgggg

SEQ ID NO: 43133 - DNA, 655 bp, Homo sapiens
  misc_feature: GYAE6OF01B8JHJ.31.14.B03.1.454.CMB.1.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagcagtagacgtcacgaccggtgctcgatttagtgtgagtagtttgggctgaggctgggttttcctcgttgctcttttaagaggtgtccagtgtcaggtgcacctggtgggaatcgtgggggaggcgtggtccggcctggggggtccctgagactctcctgtgccatgtctgcgtctgaattcatcctcaggcactatggcatgcacgtggggtccnccaggccccaggccaagggctggagtgggtgcatttanactatttgataggataattaaaaaatttcganagactcggtgaacgggtccgattcaccatctacagacgacccttacaactatacgctagtactacctaccaaatacgaaactacgtggtacgaactagttacggaaagtacgacggtactaaactttattagttgtagacgaaagtagtttcggttaggtcgagctaatacaagtgtaggtagtggggtgtactcgaacgaccggtcggggcctaagggtacctacggttcggtaccctaccgtaccgtcccgtacaccgtcccctaccgaacccgtaacgggtccccgtaagtccccgggtttccctacccccgtggtaccccctaccccgttaccaacccggtaacgccgtacccgtacccggg

SEQ ID NO: 43134 - DNA, 730 bp, Homo sapiens
  misc_feature: GYAE6OF01COAVQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccgccacggcccccaggcaaggggactgggaggtggggtgctagtttataactaatttgataggaagtaaattaaaaaattttacgacagactcgtaggaaggccgattcacctatcctaccacgacgtaccccttaccaacctactacgtctacgtactacctaccaaatagaaactagtcggtacgacgtagttagaacgaaccgacggtactaaactttattatggtagaacgtaaagtacgtttcggttggtacgagtactagttacaagttgggtaggtaaggttaggggtcggtaccgtaccggaaccgtacccgggtagggggacccgtaaggggtaaacctaccggttacgggtacccgtaacccgttcccgttccgtacccgaccggtaccccacccgaacccggaaccgggcccccttacggttccccggttcccccgttccccccgtcgggaccccccttaccccggtaccctaaccccgaaacgtccgtaccccgtaccccggg

SEQ ID NO: 43135 - DNA, 753 bp, Homo sapiens
  misc_feature: GYAE6OF01EO45R.31.14.B03.1.454.CMB.1.raw
  modified_base (188)..(188): a, c, t, g, unknown or other
  misc_feature (188)..(188): n is a, c, g, or t
  modified_base (254)..(254): a, c, t, g, unknown or other
  misc_feature (254)..(254): n is a, c, g, or t
  modified_base (320)..(320): a, c, t, g, unknown or other
  misc_feature (320)..(320): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactatggcatgcacgtgggtccgccaggccccaggcaagggctggagtgggtgactatttanactagtttgatggaagtaattaaaaaatttcgacagactccggtagaaggcctattccacacgtcnccagaccgtacccttacccaacctatacgtctacgtactactaccctaaatacgaactagttgggtagtaacgtaggttaagaaacgtaaccgaaccgggtaactaaacgttttattaacgtttaggttacggtaacggtaaaagttacgttttccgggtttaggggtttaccgaacgtactaacgttacgtaagttgggttaggtaacgttagggggtcgtaccgtttacggaaccggttacccgggtacgggggacccggtaacgggaacctaccgggttacggtaccctaacccggttccgtacccgtaccgaccgtaccccgtacccgaacccgtaaccggggcccccttaacgggttcccggttcccccgttaccccccgtagtcccccgtaccccctaccgtacccgaacgtccgacccgtacccgg

SEQ ID NO: 43136 - DNA, 1020 bp, Homo sapiens
  misc_feature: GYAE6OF01E4BED.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatcgcacgtcgggtcccgccgacggcccccagggaccgaaggggaccgtgggaggtgggtggactagttttaatactaagtttgagtagggtaaagtaaactttaaaaaagttttaccgacgtaacgaccgttcccggtaagggtaaaccggggtaccgtaacgttaccctaacccgtacttaccgtacccgaacggtaaccgtaacccccttttaccgaaaacccttagttaacccggacgtttacgttaaccgttacccttaacccgtaaaagttacggtaaaaccgtaagttacggggttaacgtaacgtaacgggtttaacggaaaccgtaaccgtaaacccgggtactttaaaaccgttttagtttaacggtttacggttacgggtaaaccggttaaaacgggtttacgtttttaccgggtttacgggtttacgaacggttaaccgtaacgttaacgtaaaggttacgggttagggtaaacggttacggggttacggtaccccggttaccggtaacccggttacccgggtacgggggtaccccgtaaacgggggtaaccctaacccgggtttacgggtacccctaccccgggtttacccgttaccccggtaaccgtacccggtaccccttaaccccgggaaaccccggtaaaccccgggggttaccccctttaacccggggttccccccgggttttacccccccgtttacccccccgggttacccgggttaaccccccccttaaaccccccggtttacccccgttaaacccccggtaaacccggggtaccccgtacccccggttaacccccggggg

SEQ ID NO: 43137 - DNA, 795 bp, Homo sapiens
  misc_feature: GYAE6OF01EKJXK.31.14.B03.1.454.CMB.1.raw
  modified_base (715)..(715): a, c, t, g, unknown or other
  misc_feature (715)..(715): n is a, c, g, or t
tcagcagtagacgtcacgaccggtgctcgatttagtgtgagtagtttgggctgagcttgggttttcctcgttgcttcttttaagaggtgtccagtgtcaggtgcaccgtggtggaatcggtgggggagcgtcggtccggccgtcggggggtccctgagacttctccgtgtcgcctagtcgttcgtcgtcgttctagtaactttcactcctcgacggacctatagtggctatcgcacggtcgggtacccgccgaccggacccgaaggtacgaacggggacgtgggtagggtgggtcgtattatttaagtactagttgacgtaaggtaaattaaacttaaaactttcgacgtactaaccggttacgtacggaaccggtaccgttacttaccgaaccgtacttaccgtaccgaaccgtaacccgtaaccccttaacccgtaaactaacgttaccgttacgtaacgttacttaaccctacaaaagtacggtaaacgtagttacggtacgtaacgttacggtaagaaacggtaccgtaaacgttacttaaacgttttagttaagtttacgggagtaaacgttaaggtttacgtttccggggttagtaacgtacgtaaacttaagttcggtaaagtttgggtcggtaggttacgggtcgtaccgaccgtacggtccgggacggacggaacgtaccggtacgtctacgttcccacaccgacncccgtaaccgaccgtacggcccttcgtccctcccgtcccctggaacccccttccaacccgtagaccgtctacccggacgg

SEQ ID NO: 43138 - DNA, 779 bp, Homo sapiens
  misc_feature: GYAE6OF01DUID0.31.14.B03.1.454.CMB.1.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgccacgtcggggtcccnccacgggcccccaggccgaaagggctgggaggtgggtgctaattttanaactaagtttgagtaggaagtaaattaaaaaagttttcgacaagtaccgtccggtaggaacgggtccgtattaccacctattcccgtaccaacggaaccgtaccccttaccaaaccctataccgtctacgtactacctaacctaaagtacgaaactagtaggtacgacgtaggttacgaacgtaacgacggtaactaacgtttattagttaggtagacgtaaagttacgtttacggttggttaccgagctaactagtaacgttggtacgggtaaggttcggggtacgtaccgttaccggaaccgtacccgggttacgggggaaccgtaacggggtaacctaccggtacgggttaccctacccggttaccgttcccgtaacccgtacccgtccccgtaccccgaacccggtaaccgggtccccctacggtttccccgggttccccttacccccccggtcggtaccccctacccccgttaccctaaccccgaacggcccgtcccgtaccccggg

SEQ ID NO: 43139 - DNA, 747 bp, Homo sapiens
  misc_feature: GYAE6OF01BZUO9.31.14.B03.1.454.CMB.1.raw
  modified_base (221)..(221): a, c, t, g, unknown or other
  misc_feature (221)..(221): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctgggggggtccctgagactctcctgtgccatgtctgcgtctgaattcatcctcaggcactatggcatgctacgtcggggtccnccgacgggcccccaagggcaaggggactggggaggtggggnggtctaattttataacgtaagttttgagtagggaagtaaatttaaaaaaattttcgataacgtaccgtaccggtaggaagggcctaattccacctactcctaccgagaccgtaccccttacaaacctatacgtctagtactcctaacctaaatcgaactagtgggtacacgtagttaacgaacgaccgtacggtactaaacttttagttacgttaggtacgaacgttaaacggttcgtttacgggtttacgggtttacggaagtacctaagttaccgtaaagttcgggtagggtaagttaggggtacgtaccgtacggaccgtaacgggtcggggaaccgaagggtacctacggtcggtaccctaccggttaccctccgaccgtaccgcccctaccggaacccgtacgggtcccctagttcccgggttccccttcccccgacgacccctacccctacccgtaccgacgaccgtccccgtaccggg

SEQ ID NO: 43140 - DNA, 707 bp, Homo sapiens
  misc_feature: GYAE6OF01EVUM0.31.14.B03.1.454.CMB.1.raw
  modified_base (345)..(345): a, c, t, g, unknown or other
  misc_feature (345)..(345): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcatatggcatgcacgtgggtcccgccaggccccaggcaaggggactgggaggtgggtggctatttatacaattttgatggagataaaaaatttacgcagaactcgtgaagggcatcacctatccgcacgacgtaccctaccaaccactacgctntactactacaatagaacagtaggtagacgtagtagaacgacgaacgtactaacttattanttagtgtacgtaagtacgttacggttacggttacggtacgtaacgtacgtacgtaagtagggtaggtaacgggttacggggtacggtaccggtacggaccgtacgggtaccgggtacggtaacggtaaccgtaacggttacggtaccgttaccgtacccgttacccgtaccgtacccgtaccccgtaaccccgaaacccgggttaaccccgggtaccccgttaccccggttacccggttaccccccgtttaccccccggtaccccggttacccccgttaacccccgttaccccgtaaccccg

SEQ ID NO: 43141 - DNA, 815 bp, Homo sapiens
  misc_feature: GYAE6OF01AM6QR.31.14.B03.1.454.CMB.1.raw
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtgggggagcgtggtccggccgtggggggtccctgagactctcctgtgccatgtctgcgtctgaattcatcctcgaggcactatggcatgccacgtcggggtcccnccgacggccccgaggacgaaggggctgggagtgggtgactatttanactaattgagtaggaataaattaaaaacgtttcgacagtaccgtcggtaggacggcctattaccaccatcctaccgaacgtaccgtaccccttaccaacctacgtacgcttagtacctacctaaccaaagtacgaactagtggtacgacgtaaggttagaacgtaaccgtacggtaacttaaactttagtttaagttggtaacggtaacggttaaaggttacgttttaccgggtttagggttaccgtaagtactaacgttaacgtaaggttgggtagggtaaggtcggggtacgtacccgttaccggaaccggtaccgggtacggggacccggtaaacgggtacctaccggttccggtaccctacccggtttaccctacccgtaccgtaccgtcccccgtaaccccggaaacccggtaccccgggttacccccttacccggttcccccgggttcccccctttacccccccggtacccggtaaccccccttacccccgttaccccgaacccggtaaaccggttcccggtaccccggttaaccccgggg

SEQ ID NO: 43142 - DNA, 945 bp, Homo sapiens
  misc_feature: GYAE6OF01EOGNH.31.14.B03.1.454.CMB.1.raw
  modified_base (222)..(222): a, c, t, g, unknown or other
  misc_feature (222)..(222): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaatttcatcctcgaggctactatggcatcgcacgtcgggcccnccgacggccccaggcgaagggctgggagtgggtgctatttanactaatttgataggaagtaaattaaaaaagttttcgacaagacgtcggtaggaacgggccgtaattccaaccattcctaccgaaggtaccgtaaccccttacccgaaaccctaagtaccgtcttagtacttacctaacccaaaatacgaaactagtgggtaacgaacgtaaggtttacggaaaacggtaccgtaaaccgggtaccttaaaacgttttaagttttaacgtttagggttaacggtaacggtaaaagtttacggtttttacggggtttacgggtttaaccggacgtaacctaagttaacgtaaacggtttggggttaaggggttaacgggtttaagggggtccggttacccggttaccggtaaccccggtacccggggtacgggggaacccggtaaacgggggtaaccctaaccgggtttaccggggttaaccccttacccccgggtttaacccgtttcccccgtaaacccggtaccccggtaccccccgttaaaccccgaaacccccggggtaaaccccgggggttcccccttaaaccccggggttttccccccggtttacccccccggttttacccccccccgggacggttaaccccccccgttaaccccccgttacccccgttaaaacccccggaaacggtaacccccgtaccccggttaaccccccgggg

SEQ ID NO: 43143 - DNA, 902 bp, Homo sapiens
  misc_feature: GYAE6OF01EK4W6.31.14.B03.1.454.CMB.1.raw
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaatttcatcctcaggcactatggcatgcacgtcgggtcccnccgacggccccgaggacaagggactgggaggtgggtgctagtttanactaagtttgataggaagtaaattaaaaagtttcgacaagtacgtaccggtaggaacggtcctagttaccacctactcctaccgaagaccgtaccccttaccaaacctacgtacgtacttacgttacttaccgtaaccctaaaagtacgaaacgtagttcgggttaacgaacttaagggttaacggaaaccggaaccggtaaccgggtaactttaaacgttttaacgtttaacgtttacggtaacggtaaacggttaaaacgtttaccggtttttacggggtttacgggttttaaccggaacgtacctaaagttaccgtaaaggtttcgggtaagggtaaggttacgggggttcggtaacccgttaaccgggaacccggttacccgggtacggggggtaacccgtaaacgggggtaaaccctcccggggtttacgggtaccccgttaacccccggttccgttacccccggtacaccccgggttacccccgtacccccggtaaacccggtaacccgggggtaccccccttaccggggtttaccccggtttccccccgttacccccccgtccgggtaaccccccttaccccccgtaccccgtaacccgaaacggtccccggtaccccgtaaccccggg

SEQ ID NO: 43144 - DNA, 777 bp, Homo sapiens
  misc_feature: GYAE6OF01D262V.31.14.B03.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtggggggtccctgagactctcctgtgccatgtctgcgtctagaacttcatccctgaggcactagtggcatgcacgtcgggtcccncacggccccaggaccgaagggactgggaggtgggtgctatttacaactaagtttgagtaggtaagtaaattaaaaacgtttcgactacgtaccgtaccggtaggaacgggtcctaattaccaaccgtactccctaccgaacggtacccgtaaccccttaccgaaacctacgtaaccgtcttacgttaactacctaacaaaagtacgtaaacgtaggtaggtacgaacgtaaggttaacgaacgtaacgtaaccggtacttaaactttagttacgttagtacgtaacggtaaagtttcgtttcggtttacgggttacgaagtactaagtacgtaagtgggtaggtaggtacggggtcgtaccgtacgtaaccggacgggtacgggaccgaacgggtaacctcggtcggtaccctccgtactcccgtacgacccgtaccctacccggaaacccggtacccgggtcccctaacggttccccggttcccccttaccccccggtcgaccccccttaaccccgtaccctaaccggaacggtcccgtaccccggttacccggg

SEQ ID NO: 43145 - DNA, 724 bp, Homo sapiens
  misc_feature: GYAE6OF01BQHJN.31.14.B03.1.454.CMB.1.raw
  modified_base (257)..(257): a, c, t, g, unknown or other
  misc_feature (257)..(257): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcagtgcacgtgggtccgccacggccccaggcgaagggctggagtgggtgctatttanactaatttgagtaggaagtaattaaaaaattttcgacagaccgtccgtaggaacgggccgattcaccatcctaccagacgtacccttaccgaaccatacgctgtactctacaaatcgaactatggtanactaggttacgaaagtacgacggtactaaacgtttattaagttgagaacgtaaagttagtttcgttaggttacgagtactaatacaagttggtaggtaaggttacgggaggtacctacggaacgtaacccggttcgggggaacccgtaaggggtaaacctaccgggttacggtacctacccggttcctccgttaccgaccgtccccttacccgaaacccggtaaccgggtcccctaaccggtttccccggttccccgtttaccccccccgagggaccccccttacccccgttaccccgtaaccccggaaacggtacccggtaccccttaacccccgggg

SEQ ID NO: 43146 - DNA, 781 bp, Homo sapiens
  misc_feature: GYAE6OF01D3LZW.31.14.B03.1.454.CMB.1.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcactcctnaggcactagtggcatggccacggtcgggtcccncgacggccccaggcgaagggctggagtgggngctagtttanactaattgatacggaataaattaaaaatttcgacaacgaccgtcggtaggaacgggtcctattaccgaccactcctaccagaacccgtaccccttaccgaaccttataccgtcttacgttaactacctaaccgtaaaagtacgtaaaccgtaagttagggtactaaacggttacgttaaggaaaccgtaacgtaaccgggtaaccttaactttaagtttagttgggtaacgaacggttaagttacgtttacgggtttcggtacgtaagcttaacgtacgtaagttgggtaggtaggttagggtccggtactacccggtaacggaccgggtacgggacgtaacggtacgacggtttcccggtaccgtaacccttccgtcccgtaccgtaccggtaaccctaccccggaaaccggttaaaccggggcccctttaacgggcccccgttccccgttcccccggtacggacccccttaccccgtaccccgtaacgtaacccggcccgtacccgtacccgggg

SEQ ID NO: 43147 - DNA, 669 bp, Homo sapiens
  misc_feature: GYAE6OF01ARGWI.31.14.B03.1.454.CMB.1.raw
  modified_base (250)..(250): a, c, t, g, unknown or other
  misc_feature (250)..(250): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgcacggccccaggcaagggctggagtgggtgcatttanatattgatggaagtaattaaaaatttcgactagactcgtaggaacggccgattcaccatctaccgagacgacccttccaactatacgctagtactctacaatgaactagtaggtagactagttagaacgacgtacggactaattacgttagttagtagaacgtaagtacgtttcggtttacggttcgaagtacgtaattaccgtaagtggttaggtagttacggggtcgtaccgtcgtaaccgtacccggtggggacccgtaagggaacctacgtcggtacctaccgtcctaccctcgtacgtcccgtacccgaacggtaaccggtcccctaacggttccccggttcccttcccccccgggtacgtcccccgtaaccccgttaccctaacccggtaaacgtcccgtaccgtaccccggg

SEQ ID NO: 43148 - DNA, 767 bp, Homo sapiens
  misc_feature: GYAE6OF01ELCAK.31.14.B03.1.454.CMB.1.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcggtggtccggccgtggggggtccctgagactctcctgtgccatgtctgcgttctagaattcatccctcgaggcaactagtggcagtgcctacgtcgggtccgccgacggccccaagggcgaaaggggtctgggaggtgggngactatttanaactattgagtaggaagtaaattaaaaaacgtttacgactacgtactacggtaggaacggccgtattaccaacgtactctaccgacgtaaccgtacccttaaccaaccactacgtcttagtactaccgtaacaaagtacgtaacagtggtagacgtagttaagaacgaactaacggtactaaacgtttattagtttaggtaacgtaacggtaaagtttacgtttcgggttacggttacgtaacgaactaacgtaacgtaagttgggtaaggttacggtaggggttacggcgtaaccggtaccctaccggggttacgggaaccgtaacgggaaacccttcggtaccggtttacccgaacccgtttcccgtacctaccgggaaccctcccgtaccccggaaaccgtaacggtccccgttaccgttaccccggttcccttacccccgcggaccccttaaccccgccttaaccgaacgtccgacccttacccggg

SEQ ID NO: 43149 - DNA, 795 bp, Homo sapiens
  misc_feature: GYAE6OF01CXILF.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggctggagtgggtgcatttatacaatttgataggagtaattaaaaaattttcgacaagtactccggtaggaagggccgattcaccatcctaccacgacgtacccttacaacctataacgactcgtaactcctaaccaaatcgaactagtggtacgtacgtagttagaagtaccgacggtactaaacgtttaatttagttacgtagaaccgtaaagttacgtttcgtttaggttacgaagtcaagttacgaaagttgggtagggtaaggtacggggtcggtaccgttaccggaaccgtaacccgggttcgggggaacccgtaaaggggtaaacccgtaaccgggttacgggggttaccccttaaaccccggttcccgttacccgttacccgaaccccggttacccgtacccccgtaaacccggtaaacccgggggtaccccctacggtttacccccggggttcccccttttaccccccccggttaccggggaccccccttaaacccccccggttccccgttaaaccccggaaacccggtacccggtaccccgttaacccccgggg

SEQ ID NO: 43150 - DNA, 956 bp, Homo sapiens
  misc_feature: GYAE6OF01CD8QU.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggttgaatcgtgggggaggcgtggtccggccgtggggggtccctgagactctcctgtgccatgtctgcgtctgaattcatcctcaggcactatggcatgcacgtcgggtcccaccgacggcccgaggacgaagggctgggaggtgggtgactatttataactaatttgagtaggaagtaaattaaaaaagtttcgacaagtacctacggtaggaacgggcctaattaccacctactcctaccgaacgtaaccgtaaccccttaccaaaccgtaacgttaccgtaccgttacgttaaacctacccttaaaccgtaaaacgttaacggtaaaaccgtaggttttaacggggtaacgttaaaccggttaaaggtttaaacgggaaaccgtaaaccgggtaaaacccgggttaaacctttaaaaaccgttttaagttttaaacggtttacgggtaacgggtaaaccggtaaaaagggttttcggttttaacggggttttcggggttaaccgaacgttaccgttaaacttaacggttaagggtttaggggtaagggtacgggttaacgggggttccggtaacccgttaccggaacccggttaaccgggggaccggggttaacccggaaagggggtaacccctacgggtttaccgggtaaccccgaccggtttacccgtacccgtaaccggacccgttccccgtaaacccccgggaaccgggtaaccccgggtccccgttaaccggtttaccccggttcccccccgtttacccccgggtacggtaacccccccgtaccccccgttaaaccccgtaaccgggtaaaaccgtcccgggtcccccgttaaacccggggg

SEQ ID NO: 43151 - DNA, 660 bp, Homo sapiens
  misc_feature: GYAE6OF01AF1KO.31.14.B03.1.454.CMB.1.raw
  modified_base (188)..(188): a, c, t, g, unknown or other
  misc_feature (188)..(188): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggccgtggggggtccctgagactctcctgtgccatgtctgcgtctgaattcatcctnaggcactatggcatgcacgtgggtcccgccaggcccccaggcaagggactgggagtgggtgctatttatactaatttgatggaagtaattaaaaatttacgcagactccggtaggaagggcctattccaccatcctaccagacgtacccttaccaactataaccgcttagtactcctacaaatcgaaacagtgggtacgaactaggttacgaacgacgacggtactaaactttattagttgtagtacgtaaagtgtttcggtttaggttacgtaagtacgtaatactaagtggtaggtaagtaggggtcacgtacggacgtaccgggtcggggaccaaggggaaccacggttcggtccaccgtcctaccgtccacgccctaccgaacccgaccgggtccctaggttcccggtccctttccccccggtggcccctaacccccgttcccaccgaacggtccgcccgtacccggg

SEQ ID NO: 43152 - DNA, 866 bp, Homo sapiens
  misc_feature: GYAE6OF01BJ94Q.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacgggcccccaggcaaggggactgggagtgggtgctatttatactaatttgataggagtaaattaaaaaattttaccgactaagacctaccgtggaacggggtacccgtattccaaccgaattcctacccgaacggaacgtacccctttacccaaacccgtataccggacttaggttaaccttccttaacccaaaacgttaggaaacctaagttagggttacgaactaaggtttaacggaaacggtaaccgtaaccgggtacttaaaacctttagtttaacgtttagtagggtaacgaaaggttacgttttaccgggtttaggggtttaccggaacgtactaacgttaccgtaaagtttggggttaggggtaagtttaagggggttcgggaccgttaccgggtaacccgtaacccgggttcgggggaaccccgtaacgggggtaaaccccgtacgttaccgggttacccgacccggtttcccgtaccccttccgaacggtacccccgttacccgaaaccccggtaaaccgggggtcccccctaaacgggtttcccccggttcccgtttaccccccccggttcgggacccccctaaccccccgttccccgtaaccccggaaccggttacccgaccccggttaaccccggg

SEQ ID NO: 43153 - DNA, 954 bp, Homo sapiens
  misc_feature: GYAE6OF01C0D2E.31.14.B03.1.454.CMB.1.raw
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtcgggtccnccacggcccaggcaagggactgggaggtgggtgctaagtttatacgtaagttttgagtaggtaagtaaatttaaaaaactttttacggactaacggtaccttacccggtaggaaacggggtccctaacttacccgaaccctaacttccctaccgaacgtaaccggtaaccccctttaacccaaaccctaacttaaccggtacctttacggttaaccttaccctaaccgtaaaaacgttacggtaaaaccgtaggttaacggggtacgtaaaccgttaaggtttaacggaaacggtaacccggtaaccggggtaacctttaaaacgtttttaatttaacggtttaacgggttacggtaaaccggttaaaaggtttacgttttaccggggttttacggggtttaaccgtaacggtacccgttaaagttaacccgttaaaggtttaggggtttaacgggtaaacgggtttaacggggggttcggaacccggtttacccgggaacccgttaacccggggttacggggggaaccccgtaaacgggggtaacccttaaccgggttccgggtaccctaccccgggtttacctccccgtaccgacccggtacccctaacccccggaaccggtaaccgggtccccctaaccgggtttccccggttaccccggtttaccccccgtcgggaccccttaccccccgttacccgtaacccggtaaacgcccggtcccgttaacccccgggg

SEQ ID NO: 43154 - DNA, 696 bp, Homo sapiens
  misc_feature: GYAE6OF01C8I2J.31.14.B03.1.454.CMB.1.raw
  modified_base (222)..(222): a, c, t, g, unknown or other
  misc_feature (222)..(222): n is a, c, g, or t
  modified_base (617)..(617): a, c, t, g, unknown or other
  misc_feature (617)..(617): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtggggggtcctgagactctcctgtgccatgtctgcgtctagaattcatcctcaggcactagtggcatcgcacgtcggggtccnccacgggccccagggaccaaggggctgggagtgggtgactatttacgtataattgagtaggaagtaaattaaaaaattttacgacaacgtaccgtccggtaggaacggggtcctaactttccaacctactctaccagtaccgtacccttaccaaccgtataccgtctactactacctaccaaatacggaacctagtacgggtacgaacgtagttaacggaagaaccgtacggtactaaactttagttaagtttaggacggtaacgtaaagttagtttacgggtttacggtgtaacggtatacgttacaagttgggaaggttacggtagggttcgccgtacggaacaccgggtaggggaccgaacgggacctacgtcgggtaccaccgttctaccncgacgccctacgaaccgacggtcccctagtcccgttcctacccccgtggacccctcctacccacgacgcgcgtacccgg

SEQ ID NO: 43155 - DNA, 1028 bp, Homo sapiens
  misc_feature: GYAE6OF01CDJN7.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgccacctggtggaatcgtgggggagcgtggtccggccgtgggggtccctgagacctctcctgtgccatgtctgcgtctagaattcatccctagacggcaacttagcggacagttcgaccgaccggttccggggtacccgacccgaaccgggtacccccgaaggggtaccggaaaagggggtccgttagggggaccggggtttaggggttcggtaacctttaacgtttttaaagtaaaccgttaaaggttttggaaaggttaaggtaaagttaaaaactttaaaaaacgtttacggacctaacggtaccgtacggtacggaacggtccgtaacttacccgactaacgtccgtaaccgaacgtacccgtacccttaacaacctacgttaacgtcttacgtaacttaccctaacaaagtaccgtaagtacggttggtaactaaggtaaacgttaacggaaacgtaacgtaacgttaaacgttaattttacgttagttacggtagtaaccggttaaagttcgggttttacggttacggtaccgaacgttacgttaacgtaaacgtttaaggtcggggttacgggttaaagggttaccggggttaccgtacccggttaacgggtaacccgggtacccgggtttaaaccggggggaaccccttaacggggtaaacccggtaccgttttacccgggtaaccccgttaaccccgttcccgttaccccgaaccggttaccccggtaaaccccgtacccccggtaaaacccggggaacccccggtcccccggtttaaacccgggttccccccccggtttaccccggttaaacccccccggttcccccggtaaacccccccgttaccccccggtttaaacccccgtaaccgggtaaaaacccgttccccgggttaaaacccggttccccccccggggg

SEQ ID NO: 43156 - DNA, 734 bp, Homo sapiens
  misc_feature: GYAE6OF01B69FN.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggcttggagctgggttttcctcgttgcctcttttaagaggtgtccagtggtcaggtgcacctggtggaatctggggagcgtggtccggcctgggggtccctgagactctcctgtgccatgtctgcgtctgaattcatcctcaggcactatggcatgcactgggtccncacggccccaggccaagggactggagtgggtgctatttanactaatttgatggaagaattaaaaaattttacgacagacgtccgtagaagggccgattcaccatcctccagacgtacccttaccaaccactacgtctgtactccttaccaaattagaaccagtggtacgacgtagttagaagacaacggactaaacgtttattacgttgtagacgtaaagtacgtttccggtttaggtttcggagtactagtactaaagttgttaggagttaaggggtcggacgttccggaacctaccgggttacggggaccgtaagggggtaacccgtaacgtttccggggtacctaaccccggttcccttaccccgtcccgtaaccggtccccttacccccggaaacccggaaaccccgggggtcccctaacggttccccgggtttccccctttcccccccggtacggtacccccctacccccgtaccccttaccccgaacggtaccgtccccgttaacccccgggg

SEQ ID NO: 43157 - DNA, 903 bp, Homo sapiens
  misc_feature: GYAE6OF01DZBVH.31.14.B03.1.454.CMB.1.raw
tcagcagtagacgtcacgaccggtgctcgatttagtgtgagtagtttgggctgagcgtgggtttcctcgttgctcttttaagaggtgtccagtgtcaggtgcacctggtggaatcgtgggggagcgtggtccggccgtgggggtccctgagactctcctgtgccatgtctgcgtctgtaattcatcctcgaggcactagtggcatgcacgtcgggtccgccgacggccccaggaccgaagggtactgggaggttgggtcgtacttaagtttactaactaagtttagaagtaggaaagtaaaatttaaaaaaacgttttccgacgtaacgtaaccgttaccggtaaggtaacggggtacctaacttaccaacctacttaccgtaaccgaacggaacccgttaacccctttaacccgaaaccgtaacgttaccgtccgtttacgtaaacttacccttaaaccgtaaaagtacgaaacgttacggttacgggtaacgtacgtaacggtttaacggaaaccggtaaccgtaaaccgggttaaccttaaaacgttttaagtttaacggtttacgggtaacggtaaaccggttaaaaggttccggttttacggggtttacgggtttaacgaacggtaacctaaagttaccgtaaaggttgggttaagggtaacggttacggggtcgtacccgtacggaaccgtaccggggtacgggaacccggtaagggtacccttaccggttcggtacccgtaccggttcccgttaccgtaccgtaccgtacccctaacccggaaaccggtaaccgggtccccttaccgggttccccggttcccccgttcccccggtaccggtacccccttaaccccgttacccaaccgtaaaccggtcccgtcccggttaccccggg

SEQ ID NO: 43158 - DNA, 824 bp, Homo sapiens
  misc_feature: GYAE6OF01A0T8N.31.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatctggggagcgtggtccggctgggggtccctgagctctcctgtgccatgtctgcgtctgaattcatcctcaggcacgtatggcatgcacgtgggtccncaggccccaggcaagggctggagtgggtgactatttanactaatttgatggaagtaattaaaaatttcgactagacgtaccgtaggaacggtcctaagttcaccgtactcctaccgacgacgtacccttaccaacctatacgctagtactcgtaccaaagtcgaactacgttaggactacgtaacgttagaacgacgtaacggtactaaactttagttacgttacggtacgaccgtaaaagttacgtttacggttacgggtttacgtaacggtacgtaacgttaccgtaaagttaggggttacggaaggtttaacgggggtcggtcccgttaacgtaacccgtaccgggtttacggggaacccgtaaacgggggttaaccccgtaaccggttaccggggttaacccgttaacccgttacccggttaccccgttaacggtaccccgttaccccgttaacccggtaaaccccggtaaacccggggttcccccggttaaacggtttccccggggtttaccccctttaccccccccgggttaacgggacccccccttaaaccccgttaccccgttaaaccccgaaccggtaacccggtccccttaaacccccgggg

SEQ ID NO: 43159 - DNA, 844 bp, Homo sapiens
  misc_feature: GYAE6OF01C9Z4I.31.14.B03.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcctgggggtccctgagctctcctgtgccatgtctgcgtctgattcatcctcaggcactatggcatcgcacgtcgggtaccnccgacggccccaggcaaaggggacttgggaggttggggtgacttaagtttttaanaacgtaagttttgagttagggaaagttaaaatttaaaaaaacgttttccggactaacggtaaccgttccgggtaaggaaacggggcccgttacttaccaacctacttccgtacccgaacggtaccgtaaccccttaccaaaccctagttacccgtcttacgttactaccttaaccgaaaagtacgtaaacgtggttacggtacgaacgtaaggtttaacgaaacgtaaccggtaccgggtaaactttaaacgtttagtttaactttgggtaaggtaaccgtaaaggtttacgttttcgggttagggttaccgagtacgtaagttaccgtaaggtttacgggtagggtacggttacggggtcggtaccctacgggaacccggtaccgggttacggggaacccgaacgggtaaccggtacggttcggttaccccgaccgtttccgtacccgttccgacccggtacccgtacccgaacccggtaaccgggtccccgttacggttccccggttccccttcccccgtaccggtcccctaaccccgttcccgaacccgaacggtacgtcccgtaacccggg

SEQ ID NO: 43160 - DNA, 897 bp, Homo sapiens
  misc_feature: GYAE6OF01B6NOT.31.14.B03.1.454.CMB.1.raw
  modified_base (189)..(189): a, c, t, g, unknown or other
  misc_feature (189)..(189): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtcgggtcccgccacggcccccaggcgaagggtctgggaggttgggtggactattttagtactaagtttgagtagggtaagtaaagttaaaaaaagttttaccggactaagtaccgttacccggtaggtaacggggtaccgtaacttaccgaacctacttaccgtaccaacggtaccgtaaccccctttaaccaaaccctaacgttaaccgtacttacggttaaccttaccgtaaccctaaaaacgtacgtaaacccgtaagttacgggtacgtaacgttaacggttacggaaacggtaaccgtaaaccgggtaacgttaaacctttaagtttaacgtttagtaacgggtaacggtaaagtttacggtttacgggtttaggtttaaccgtacggtactaacgttacgtaaagttcgggtaaggtaggttaacggggtaccggtaccgttaccgggtaaccgtacccgggtacgggggaacccgtaacggggtaaaccctcgggttaccggtaccctaaccccggtttcctacccgtacccggtaccgtaccccctacccggtaaacccggtaccggggtacccccctaagggttccccccggtttccccgttaccccccggtcccgtaacccccgttacccccctacccctaaacccggtacggtaccccgtacccgttaacccccgggg

SEQ ID NO: 43161 - DNA, 888 bp, Homo sapiens
  misc_feature: GYAE6OF01CVKKY.31.14.B03.1.454.CMB.1.raw
  modified_base (242)..(242): a, c, t, g, unknown or other
  misc_feature (242)..(242): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtggggagcgtggtccggccgtgggggtccctgagactctcctgtgccatgtctgcgtctgaattcatccctgaggcacgtatggctagtcgctacgtcgggtcccgaccgacgggcccccggganaaaggggctgggacggtggggtcgactaattttacaacttaagtttgaagtagggaaagtaaaactttaaaaaagttttacgacgtaacgtaccgtccggttacggaaacggggccgtactttacccaaccgtaacttcctacccgaaggtaaccctaaccccctttacccaaaccacgttaccgtacgttacgttacctacccttaacccgaaaagtcgaaacctagttacgggtacgaaaccgtaggtttaacggaaacgaccggtaaaccggtacctttaaaacgttttaattttaggttacgtaacgggtaacgtaaaaaggtttcgttttacgggtttacgggttacgaaacggtactaaacgttacgtaaaggttgggtaaggggtaacggtttaggggtaccgtacccgttaaccggtaacccgtacccggggttaacggggggaacctaaacgggggaaccctaccggttcgggtacccttaccggttcctacccgtacgcccgtaccctacccgaaacccggtacccgggaccctacggttcccccggttaccccttccccggtacccggtacccccctaaccccgttcccgaaacccggaacgtccccggtaacccgtcccggttaacccgggggg

SEQ ID NO: 43162 - DNA, 686 bp, Homo sapiens
  misc_feature: GYAE6OF01DYTSI.31.14.B03.1.454.CMB.1.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactatggcatgcacgtgggtcccncacggcccaggcaagggactgggagtgggtgctagtttatactaatttgagtaggaagtaaattaaaaaattttacgactagtactccggtaggaacgggccgtattccaacctatcctccgagtaccgtaccccttaccaacctagtacgtctgtactcctaaccaaatcgaacagttggtacgacgtaggttaagaacgacgtacggtactaaactttatttacgttaggtagaacgtaaagtacgtttcggttaggtaccgtagtctaagtactaagttggtagggtagtagggtgtccgtacgaccgtaccgggtcggggaccgtaagggaacctacgtggtcccgtaccgttcctccgtacaccgtccctacccgaaccggaaccggtcccgtagttccccggttcccttaccccccggtgaccccctaccctacccgtacccgaacggccgtccgtacccggg

SEQ ID NO: 43163 - DNA, 730 bp, Homo sapiens
  misc_feature: GYAE6OF01DDYQR.31.14.B03.1.454.CMB.1.raw
  modified_base (189)..(189): a, c, t, g, unknown or other
  misc_feature (189)..(189): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctnaggcactatggactatgccacgttcgggcccgccgacggaccccagggacgaaagggcgtgggaggtgggtgacttaagtttataacgtaagtttgagtaggaaagtaaaattaaaaactttcgacacgtaccgtacgtaggaacggcctattccactactcctacacgtaccgtacccttaccaactactacgtcgttagtaactacctaacaaactagaaacctaggtacggtataacgtaaggtacgaaacgtaccgaacggtaactaaagtttacttagtacggtaggtaacgtaaagttcgttcggttaggtacgaatacgtaagtactaaggttggtaaggtagtacgggtcgcgttaaccggacggtaccgggtcggggaccgaacgggtaacctacggtcggtacccgaccttccgaccgtacccgacggtccccctaaaccgaaccgggtacccggtaccctcgggttccccgttccccgtcccgtaccggacccttaccccgttaccgacgaacgccgacccgtaccgggg

SEQ ID NO: 43164 - DNA, 812 bp, Homo sapiens
  misc_feature: GYAE6OF01CI57E.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcactgggtccnccaggccccaggccaagggactggagtgggtggcagtttanactaatttgataggaagtaattaaaaaattttacgacaacgtaccgtaccggtaggaaacgggccggtaatttaccgaaccattacctaccgaacgacgtaacccctttaccaaacctacttaaccggcttacgtaacttacctaccctaaaatacggaaactagttagggtagtaacctaggtttaacggaaacgtaccgaaccggtactaaaacctttaagtttaacgtttaggtacgaaccggtaaaagttacgtttaccggttttaggggttaccgaagtacgtaagtaaccgtaaagttggtagggtaacgttaagggggttcgggtaccgtacggtaacccgacccgggtacgggggtaacccggtaacggggaaacctaccgggtacgggttacccaacccggttcccgttcccgtaccgtacccggtcccgttacccccgaacccggtaaccgggaccccctacggtttccccgggttcccctttccccccggccggtaccctacccccgttacccttacccggaaacgtcccggacccgtaacccggg

SEQ ID NO: 43165 - DNA, 770 bp, Homo sapiens
  misc_feature: GYAE6OF01DH4FI.31.14.B03.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtctggccgtgggggggtccctgagctctcctgtgccatgtctgcgtctgtaattcatccctnaggctactatggcatcgcacgtcgggtcccgccgacggccccaggacaagggcngggaggtgggtgctatttatataatttgaagtaggaagtaaaattaaaaaacttttacgacaaggaccttaccggtaggaacggggtcccgtaatttaccaacctacttcctacccgaacgaaccgtaaccccttacccaaaacctacgtacgtctacgtactacctaaccaaagtacgaaactagtcggtacgaagtacgtagaaacgtacgaacggtactaaacgtttaattacgttaggtagaaccggtaaagttacgtttacggttagggttacagtactatacgtaagtggtaggtaggtacgggtcgtaccgtacggaacccggtaccggggttacgggacccggaaacgggtaacctaccggttaccgggtacccgtaccgttcccttacctaccgtaccgcccgttacccgaaaccggtacccgggtcccctaacgggttccccggttcccccgtttaccccccgccgggtacccccttacccccgtaccccgaaccgtaacgtcccgtaacccgg

SEQ ID NO: 43166 - DNA, 828 bp, Homo sapiens
  misc_feature: GYAE6OF01DC3RI.31.14.B03.1.454.CMB.1.raw
  modified_base (194)..(194): a, c, t, g, unknown or other
  misc_feature (194)..(194): n is a, c, g, or t
tcagcagtagacgtcacgaccggtgctcgatttagtgtgagtagtttgggcgtggagctgggttttacctcgttgcttcttttaagaggtgtccagtgtcaggtgcacctggtggaatcgtgggggaggcgtggtccggcgtggggggtccctgagactctcctgtgccatgtctgcgtctgaattcattcccnaggacactagtcggcatgcacgtcgggtcccgaccaggcccaggcaagggctggagtgggtgactagtttatactaagttagagtaggaagttaaagttaaaaaactttacgtacgagtaccgtaccggtaggtaacgggcccggtaacttaccgacctagttaccgtaccgaacggtaaccgtaaccccgttaccaaacctacgtaaacgtcgttagtaacctcctaaccaaacgttacgaaacctaagtcggaacgtacgtaaggttacggaaagtaaccgtaacggtaactaaacgtttagttaacgttacggtaacgtaacgtaaaacgtagtttaaccggtttagttacggaagtacgtaataacgtaagttaggtacggtaggttacgggtgtaccgtacggaaccgtaccgggtggggtaacccaagggtaaccctacgggttcggtaccgtacccgttaccttacccggtacctaacccgtacccgtacccgtaacccgggaaacccggggttccccttaaaccgggtttccccggttaccccccgttttacccccggaccggtcccccgttaacccccgttacccggaacccgtaacccggtacccggtaccccgtaacccgggg

SEQ ID NO: 43167 - DNA, 885 bp, Homo sapiens
  misc_feature: GYAE6OF01DSMSD.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctctgtcgccatgtctgcgtctagaattcatcctacgaggctactagtcggcagtcggactacggttccgggcccgaccgaccgggacccccgaagggaccgaaaggggtacgtggggaagggttcggggtagtaccttaattttaacgtaacgtaagtttagaaggtaaggtaaagttaaaaattttaaaaaacgttttcgacgtaacggtaccgttaccggtaggaacgggtaccgtacttacccaacctacgttacctaacccgaacgtaacccgtaaccccttaaccctaaaccgtaacgttaccgtcttaacgtaactaccctaaacgtaaacgtacgaaacgtaggttacggtaacgaacttaggtaaacgaaccggtaccgaaacgtaacttaaactttagttagttagacgtaaacgttaaaggttcgttttacgggtttacggtaccggaagtacttaacgtagttaaaggttgggtaagggttacggtaacggggtcaacccggtacggtaaccggtacccgggtacggggaacccgtaaacgggaccgttacggttccggtaaccctccgttacccgtccgtaacctcccggtaaccccacccggtaaacccgggtacccgggtccccgtaaccgtttccccgggttaccccctttccccgggtccgaccccctaaccccttccccggaaaacgtacggaccctacccgtacccgggg

SEQ ID NO: 43168 - DNA, 715 bp, Homo sapiens
  misc_feature: GYAE6OF01DKOK2.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctgggggggtccctgagactctcctgtgccatgtctgcgtctagaattcatcctcaggcactatggcatgcacgtgggtccnccacggccccaggcaaagggactggagtgggtggactatttatactaaatttgagtaggaagtaaattaaaaaaattttcgactaaggactaccggtagaaagggccgtaattccaaccagtcctaccagacgtaccccttccaaacataacgctgtaatctaccaaaatcgaaacatagggtcacgtagttagaacgaacacggtactaaacgtttattattaggtgaacgtaaaagtactttcggtttaggttacggagtccaattacaaagttggttaggaagttaggggtcgcgttaccgactaaccgggtgggggaacccaagggaacctcgttacggtacctacccgttcgtacccacgtaccgtaccctacccgaaccggtaaccggggtacccctaaggttccccgggttacccctttaccccccccgtagggaacccctaccccccttacccgtaaccccgaaaacggcccgttctaaaccccccggg

SEQ ID NO: 43169 - DNA, 866 bp, Homo sapiens
  misc_feature: GYAE6OF01AJ6IE.31.14.B03.1.454.CMB.1.raw
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (487)..(487): a, c, t, g, unknown or other
  misc_feature (487)..(487): n is a, c, g, or t
tcagcagtagacgtcacgaccggtgctcgatttagtgtgagtagtttgggctggagctgggttttcctcgttgctcttttaagaggtgtccagtgtcaggtcgcacctggtggaatctgggggagcgtggtccggcctgggggtccctgagactctcctgtgccatgtctgcgtctgaattcatccnaggcactatcggcagtcgcacgtcgggtcccnccgacggccccaggacctaaggggcctggggaggtcgggtaggactaattttacacgtaagtttgagtacggaagtaagttaaaaaacgttttcgacacgtacgtccggtaggaacgggtccgtaactttccgacctaacttccgtacctacggtacgtacccctacgaacctacgtaccgcttagtactacctaccgtaaatacgaacgtagttaggtcgtaactacggtttacgaaacggtacgtaaccgggacttaaaacgtttnttaagttacggtacgaacgtaaagtacggtttcggttacgggtttacgaacgttacgtaacgttacgtaaggtcgggttaagggtaacggttagggggtaccgtcccggtaaccggtaaacccggtccggggtaccgggggtaaccgtaaaccggggggtaacctaccgggttacggggttaccctaaccccggttcccggtttacccaccggtaacccgttaccccgtaccccggtaaaacccggtaccccgggttccccctaacgggtttaccccccggttccccccggtttacccccggtacccggtaccccccggttaacccccgttaccccggtaaacccggaacgggtccccgtccccgttaacccccggggg

SEQ ID NO: 43170 - DNA, 565 bp, Homo sapiens
  misc_feature: GYAE6OF01DXSD1.31.14.B03.1.454.CMB.1.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (377)..(377): a, c, t, g, unknown or other
  misc_feature (377)..(377): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggnggcatttanacaatttgatggagtaataaaaattttacgcagactccgtgaaggccgattcaccatctcagacgacccttccaacatacgctgtatactccaaatcgaacatggtgatacgttgaagacacggnaacttattattagtgacgaaagtattacggttggtttacgatcgaatcaagtggtaggatagggtggtctcggacctaccgtggggacccaaggggaaccacgtggtcgacccgtcctctcacgcctacccacgacggcccagtccggtcttccccgnggaccctaccctcctaccaagcgctacccg

SEQ ID NO: 43171 - DNA, 689 bp, Homo sapiens
  misc_feature: GYAE6OF01ACCYX.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtgctatttanactaatttgatggaagtaataaaaacttttacgacagactccgtagaacgggccgtattccactatctaccagacgaccccttaccaacctatacgctgtactctaccaaatgaacatggtgactagttagaagacgacggactaaactttatttagttgtagtacgtaaagtatttcgggttaggtttcgaagtactatacgtaaagttggttagggtaggttaacggggtggaccgtacggtaccgtaccgggttcgggggacccgtaaaggggaacccgtaacgttcggttacccacccggttccgttccctacgaccgtaccctacccgaaacccggaccggtccccgtaaggttcccccggttcccctttccccccggtaccgtacccgtaccccccttcccgtaacccgaacgtccgccccgtaccccggg

SEQ ID NO: 43172 - DNA, 914 bp, Homo sapiens
  misc_feature: GYAE6OF01EZQZ3.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgaggctgggttttcctcgttgctcttttaagaggtgtccagtgtcaggtgcactggtggaatcgtggggagcgtggtccgccgtgggggtcctgagactctcctgtgccatgtctgcgtctgattcatcctcaggcactagtggctatcgactacgtcgggccnccgaccggccccgtagggaccaagggggacctgggacggttggggtacgtacttaattttaacaacgttaagtttagaagttaagggaaagttaaaaacttttaaaaaaagtttttccggactaaacggtaccgttaccgggtaaacggggtaaacgggtaccccggttaatttaaccccaaacccgtaacgtttaaccccgttaacccggaaaccggtttaaccccggttaaacccccccttttaacccaaaaacccgttacgtttaaccccgggttactttaacggttaaccttaccccggttaaaacctaaaacggtacgtaaaaccgtagtttacggggtaacgtaaccgttaagggttacgaaacgtaaccgtacggtaactttaacgtttattaacgtttagggaaccgtaacgaaagtttacgtttaccggtttagggtaaccgacgtaacgtacgtataaaggttggtacgggtaaggttacggggtacgtaaccgtccggtaaccgtccgggttaacgggacccggtaaaggtaccctacgggtaccgtaccggttaccgttaccctctacggtacccacccgtaccccgaacggacccgggtaccctacggttacccccggtccgttccccccgtacggtacccctaaccccggttccaacccgaacggtacccgcccgttaacccgg

SEQ ID NO: 43173 - DNA, 732 bp, Homo sapiens
  misc_feature: GYAE6OF01EF4N4.31.14.B03.1.454.CMB.1.raw
  modified_base (217)..(217): a, c, t, g, unknown or other
  misc_feature (217)..(217): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (344)..(344): a, c, t, g, unknown or other
  misc_feature (344)..(344): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctggggggtccctgagactctcctgtgccatgtctgcgtctgaattcatcctcaggcactatggcatgcacgtgggtccnccaggccccaggcaagggactgggagtgggngctatttanacaatttgatgaagtaataaaaattttcgcagactccgtagaacggccattcaccatctaccagtaccgacccttaccaaccatacnctgtatacctaccaaatgaaacataggtagaactaggttaagaacgtacgaacggtactaaactttattacgtttagtacggtaacgtaaagtcgttttacggtttaggttcccggaaagtcgtaattactaaagttgggtaggtaacgttaaggggtcggtaccttacccgggtaaccgtacccgggtacgggggaccgtaacgggggtaaccctacggttcgggtaccgtaccccggttccttcccgtaccgtacccgaccctaccccgtaacccgggaaccgggccccttaaccggttccggttaccccccgtttccccccgtacgggtaccccctacccccgttacccgtaacccgaacgggacccgtcccggtaaacccccgg

SEQ ID NO: 43174 - DNA, 839 bp, Homo sapiens
  misc_feature: GYAE6OF01EJMJY.31.14.B03.1.454.CMB.1.raw
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
tcagcagtagacgtcacgaccggtgctcgatttagtgtgagtagtttgggctgagcgtgggtttcctcgttgctctttaagaggtgtccagtgtcaggtgcacctggtggaatcgtggggagcgtggtccggcctgggggtccctgagacctctcctgtgccatgtctgcgtntagaattcatcctnaggcactatggcagtgcacgtcgggtccnccaggcccccaggcaagggtactgggagtgggtgactagtttanactaatttgatggaagtaattaaaaattttcgactagactccgtaggaacggccgtattccaccgtatcctaccagtaccgacccttaccaaccataccgtctacgtactcgtacctaaatcgaaactagtacgggtagaaccgtaggttacgaaacggtaccgtaaccgggacttaaaacccgttttagtttaaacgtttgggttaaccggtaaccggtaaaaggtttacgtttaccggggttttacgggttaaaccggtaacggtaccgttaacgttaccggtaaaacgtttcggggttaacgggttaagggtttaacggggttacggggtaaccctaacccggggtaaccccgttaacccgggtaccggggggtacccgtaaacgggggtaaacccgttcggttaccggggttaccctaccccgggtttacctaccccgttacgtacccggtaccccttacccggaacccggtaaaccgggtcccttaaacggttccccggttccccccttaccccggtacccgccccgtacccccgttaccctaacccggaacgtacccgggcccttacccgggg

SEQ ID NO: 43175 - DNA, 728 bp, Homo sapiens
  misc_feature: GYAE6OF01C5U6A.31.14.B03.1.454.CMB.1.raw
  modified_base (148)..(148): a, c, t, g, unknown or other
  misc_feature (148)..(148): n is a, c, g, or t
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcctgggggtccctgngactctcctgtgccatgtctgcgtctgaattcatcctcaggcactatggcatgccacgtcggggtcccnccacggtcccccaggccgaagggcctgggaggttgggtggactaatttatactaagtttgagtaggaataatttaaaaaaactttcgactaacgaccgttaccggtaggaacggggtcctaattaccgaacctatcctaccgaacggtaaccgtacccccttaccaaaccctaacgttaccgtacttagttaacctcctaaccgtaaaagtacggtaaacctaggttacggtacgaactaggttacgaaacggaaccgacgtaactaaacgtttaagttagttaggtagtaacggttaaagtagtttacggttaggttacgaacgtaccgtataaccgtaaggttgtacgggaggttacgggtgtcctacggactaccgggtgggaacccgaagggacctacgtccggacctacccgtccttccaccgaccggtcccaccgaccgaaccgtcctacgttcccggtaccctcccgtcgaccctacccctcccactacgacgtccgaacccgg

SEQ ID NO: 43176 - DNA, 790 bp, Homo sapiens
  misc_feature: GYAE6OF01ARQIG.31.14.B03.1.454.CMB.1.raw
  modified_base (268)..(268): a, c, t, g, unknown or other
  misc_feature (268)..(268): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatcgcacgtcgggtcccgccgaccggccccaggacgaaagggacgtgggaggtggggtgctaattttanaactaagtttgagtaggaataaattaaaaaagttttcgactaacgaccgtaccggtaggaacgggtcctaattccaaccatcctaccgaagaaccgtaccccttacccaacctactaccggcttagtaacttccctaacctaaatacgaaactacgttagggtacgtaacgtaggttacgaaacgtaccgaacggtaccttaaacgtttattacgttggtacgaacggtaaagtacgtttcgggttaggttacgacgtactaataccgtaagttcgggtaggtaaggttacggggtacgtccgtaccggaaccgtaccgggtcgggggaaccgaacggggtaaccctaacggttccggtacctacccggttaccctaccgtcgtaacccgtccccttaccccggaaacccggtaaccggggtccccctaacgggttccccggttccccctttaccccccggtacggtacccccctaaccccgttacccctaacccggaacggtcccgtacccgtaccccggg

SEQ ID NO: 43177 - DNA, 763 bp, Homo sapiens
  misc_feature: GYAE6OF01DJTXF.31.14.B03.1.454.CMB.1.raw
  modified_base (487)..(487): a, c, t, g, unknown or other
  misc_feature (487)..(487): n is a, c, g, or t
  modified_base (721)..(721): a, c, t, g, unknown or other
  misc_feature (721)..(721): n is a, c, g, or t
tcagcagtagacgtcacgaccggtgctcgatttagtgtgagtagtttgggctgagcttgggttttcctcgttgcttcttttaagaggtgtccagtgtcaggtgcacctggtggaatcgtggggagcgtggtccggccgtgggggtcctgagactctctgtgccatgtctgcgtctagaattcatcctgacggactactatggcagtgaccgtacgtcgggtcccgaccgaccggccccgagggaccgtaaaggggtctggggtacggttcgggtagacttaaagttttaacgaacgttaagttttagagttaaggtaaagtaaaaatttaaaaaaacgttttccgacgtaacgtaccgttacggaacggaaacgggtccgtaactttaccgaacctattaccgtaccgaggtaacctacccctttaccaaacgtaacgtacgtcttagtaactactaaccaaatacgaactagtgtacgatagtaanaacgacacgtataacgtttatagttaggacgtaagtaaagtcgtttacgttacggtacgatcaagtactagttaggaggtagttacgggtcgtaaccgtcgaaccgtaccgggtacggggaaccaaggggtaaaccctcggttaccgacccgttaccgtcctttacccgacgaccctacccgtacccgaaccgtaaccgggtccctaacgttccccggttcccgttacccccgnggaccccttcccctaacgtaccgaaacgcgcccgtaacccgg

SEQ ID NO: 43178 - DNA, 751 bp, Homo sapiens
  misc_feature: GYAE6OF01E0C0Y.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtggggggtccctgagactctcctgtgccatgtctgcgtctgaattcatcctcaggcactagtggcatgcacgtcgggtcccgccgacgggcccccagggacaaaggggctggggaggtggggtgactaattttacaactatttgagtaggaagtaaattaaaaaagtttcgactaacgtacgtcggtaggaacgggtccgtaacttccaaccatacctaccgaagtaccgtaccccttaaccgaacctactaccgtacttacgtactacctaacctaaagtacgaactagtggtagaacgtagtacgaacgacgtacgacttaaacttattagtacgtagtaacgtaaagttcgttacgggttaggtacgagtactaatacgtaagtgggtaaggtaggtagggtacggtaccgtaacggtaaccgtaccgggtacggggaaccgtaacggggtaacctcgggtaccggttaccacccggttctacccgtacgaccgtcccgtaacccgaacccggtaaaccgggtccccgtaacggttccccggttaccccttcccccggtacggtaccccctaccccgttaccctaccgaaccggtcgaccccgttacccggg

SEQ ID NO: 43179 - DNA, 726 bp, Homo sapiens
  misc_feature: GYAE6OF01DO3PC.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatcgcctacgtcgggtcccnccgaggcccccaggcgaaggggtactgggtaggtcgggtagctaatttaacacgtaaatttggataggtaagtaaataaaaaagttttcgacaagtactccggtagaacgggccgtattcaccatacgtaccgaagtacgacccttaccaacctataccgtctagtactctaccaaatagaactatacggtacgactagttagaacgacgtacggtactacgtttatagtggtacacggtaagtagttcggttggttacgatactacgtactaacgtggtacggtaggtacgggtacggtcctaccggacctacggttaccgggggaaccgtaacgggtaaccgtaccgttacgggtccctaaccccggtcctacccgttccgaccgtcccgttaacccgaaaccccggttaagggtcccctaacggtttcccgggtccccttaccccccgtagggaccccctaaccccgttacccgtaacccgacggtaccgtcccgtaacccggg

SEQ ID NO: 43180 - DNA, 924 bp, Homo sapiens
  misc_feature: GYAE6OF01E3MK5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcactggtggaatcgtgggggaggcgtggtccggccgtgggggtcctgagactctcctgtgccatgtctgcgtctgaattcatcctcgagcactagtggcatgcacgtcgggtcccgccacggccccgaggacgaaagggacgtgggaggtgggtggactaattttaactaacgtaagtttgaagtaggaagtaaaatttaaaaaaattttaccgacgaacggtaccgttccggtaaggaacggggcccgtaattaccacctacttacctaccgaaggacccgtaaccccttacccaaaaccctactacccgtcttacgttaactccctaaaccgaaatacgtaactagttggtaacgactaggttaggaaacgacgaaacggtacctaaagtttaagtttagttacggtaacggtaacgtaaaaggtttcgttttcggggtttacggttacgaacggtacctaacgttacgttaaagttggggttaagggtaacggtttacggggggtacgtacccgttacccggggtaacccggtaccccggggtagggggtaaccccgtaaacgggggtaaacccttacccgggttaccgggtttaccccgtaaacccccggtttcccgttaccccgtacccgtacccggtaacccccgttacccccggaaacccccgggtaaacccgggttcccccgttaaacccggtttccccccggggttttaccccccttacccccccccggggttccggtacccccccttaaaccccccggttaccccgaaaccccggtaaacccggtacccggtcccccggttaaacccccgggg

SEQ ID NO: 43181 - DNA, 267 bp, Homo sapiens
  misc_feature: GYAE6OF01EDS7J.31.14.B03.1.454.CMB.1.raw
  modified_base (244)..(244): a, c, t, g, unknown or other
  misc_feature (244)..(244): n is a, c, g, or t
  modified_base (264)..(267): a, c, t, g, unknown or other
  misc_feature (264)..(267): n is a, c, g, or t
tcagcagtagacgtcacgaccggtgctcgatttagtgtgagtagtttgggctgagctgggtttcctcgttgctcttttaagaggtgtccagtgtcaggtgcactggtggatcgtgggggaggcgtggtccggccgtgggggtcccgtgagactctcctgtgccatgtctgcgtctgaattcatcctcgaggctactatggcatgcacgtcgggtccgccacggcccgaggacgaaggacgtggnggtgggtggactatttaacnnnn

SEQ ID NO: 43182 - DNA, 1141 bp, Homo sapiens
  misc_feature: GYAE6OF01EMK1C.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtccctgagactctcctgtcgccagttgtctgcgttctagtaactttcacttccctacgaggcctaacgtagtcggacagttcggccgtaccggtccggggtccccgaccgaccgggcccccgaagggtaccggaaacggggtacgtggggtagggttcgggtacggtactttaaagttttaacgtaaacgtttaaagtttggaaggttaaggaaaagtttaaaaaacttttaaaaaaacgttttccggaaccgtaaacggtacccgttaccggtaaacgggtaacgggtccccgttaacttacccaaccgtaccttacccgttaaccgaaccggttaacccgtaaccccctttaaacccaaaccgttaaccgttaaccgtacgttaacgttaacctaacccttaaaccgtaaaagtaacgtaaaccgtaggttacgggtaacgtaacgttaaggtaaacggtaaaccggtaaccggttaaaccggtaaaccttttaaacgttttacgtttaaggtttacgggtaacggtaaacggttaaacgggttttaaccggtttcgggttttaacgggtacggtaaccgtaacgttaaccgtttaaagggttaaacggtttcgggggtttaaaggggttaaccggggtttaacggggttacccgggtaacccggttaaccccgggttaaccccgggttaacccggggggtaacccgggggtaaacccgggtaaacccggggtttaaccgttaacccggggtttaaccccgggttaaccccgtaccccggtttaccccgtacccgttaaccccggtaaccccccgttaaccccgtaccccccgggaaaacccggggtaccccgttaccccccggtttaacggggtttccccccccgttttaccccccggttaccccccggcccggttaaacccccccgttaacccccccgttaaccggtaacccccggtaaaccggtccccgttaacccccggggttaaccccgggg

SEQ ID NO: 43183 - DNA, 981 bp, Homo sapiens
  misc_feature: GYAE6OF01EYFLK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagctcgtcctgtgccatgtctgcgtctgaattcatcctcgaggcacttagtcggctatgccgtacggttccgggacccgacccgaccgggcccccgaagggaccggaaacgggtacgtggggacgggttggggtcggacttattttaacgtaacttaagtttggaagttaggaaagtaaaatttaaaaaacgtttacgctaacggtaccgtacggtaacgggaacgggtcctaacttacccgaaccgtacgttaccccgtaaccgaacggtaaccccgttaacccccttaaccccgtaaacctacgttaccgtaccgtttaacgttaccttaccctaaaaccgtaaaagttacgaaaacgttacggttaggtaacgtaacgttaagggttaacgaaacggtaaccggtaccggttaactttaaaccgtttaagtttagttaggtacggtaaacgttaaagttcggtttacgggtttacggttacgacgtaactacgttaacgtaaggttcgggtaggtaacgggttagggttacgtcccgtaaccgggtaacccgtaccgggggtaaccggggtaacccgaaacgggggtaacccttaccggggtaaccggtaccccgggttaaccctttcccggtaccccgtacgtaacccccgggttaccccttaaacccgggaaaccccggttaaccccggggtacccctttacccgggttacccccgggtttcccccctttacccccccggggaaccccgttcccccggtaaacccccccgttacccggttaacccccgggtaaacgacccccggttaccccggttaaccccgggg

SEQ ID NO: 43184 - DNA, 577 bp, Homo sapiens
  misc_feature: GYAE6OF01ED6N7.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtgcatttanacaatttgatggagtataaaaattttacgacagactccgtgaagggccgattcacctagtctccgagacgacccttccaaccactacgctgtatctaccaaatgaaacatggtgaacagttagaagacacggacaacttattattagtgacgtaagtagttcgttggttacgagctatacaagtgtggagtagggtgcgtcgacgcgtcgggacagggacactggtcctacgtctcctcacgccctacccaccgaacgggccctagtcccggtcccttcccccgaggcccctaccccgtcccctaccaacgccgcctaccccgg

SEQ ID NO: 43185 - DNA, 746 bp, Homo sapiens
  misc_feature: GYAE6OF01CAXV5.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcactagtggcatcgcacgtcgggtcccgccgacggcccccaggccgaagggctgggaggtgggtggctatttatactaatttgagtaggaagtaaattaaaaaattttcgacagaccgtaccgtggaacggcctattcacctatcctacaacgacgtaccccttaccaaacctactacgtcttacgtactacctaaccaaatcgaaacagtaggtacgacgtaagttagaacgacaacggacctaacttattacttagtaggactaaagtagtttcgttaggtacgactacgtaatacaaggttggtacggtaagtggggttacggtacccgtaccggaaccgtacccgggttaggggacccgtaaacgggggtaacctaccgggttacgggttacccgtacccggttccccttacccggtaaccgtacccgaccccgttacccgaacccggtaaaccgggccccgttaacgtccccgggtttcccctccccccgtacggtacccccgtaaccccctcccgtaacccgaacggtaccgtcccgtacccccggg

SEQ ID NO: 43186 - DNA, 666 bp, Homo sapiens
  misc_feature: GYAE6OF01EOZ0D.31.14.B03.1.454.CMB.1.raw
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctggggggtccctgagactctcctgtgccatgtctgcgtctgaattcatccctcaggcactatggcatgcacgtcgggtcccgccacggccccagggccaagggctgggagtgggtgctatttanactaatttgatggagtaataaaaatttcgacagactccgtagaaggccgtattcaccatctaccagacgtacccttaccaaccatacgctgtatcctaccaaatgaactatggtagactagttacgaagacgacggactaaacttattagttgtacgacgtaaagttcgtttcggttggttcgagtcaagtcaagtggtaggagttagggtcgctacgacaccggtgggaccaagggaactacgtacggtaccacccggttccaccgttaccgacgtaccccgtacccgaaaccggtaaccggggtcccctaacggttccccgggttccctttcccccccggtagggtaccccctacccccgttaccccgtacccgaaacgggtccgccccgttaaaccccggg

SEQ ID NO: 43187 - DNA, 913 bp, Homo sapiens
  misc_feature: GYAE6OF01CRD2Y.31.14.B03.1.454.CMB.1.raw
tcagcagtagacgtcacgaccggtgctcgatttagtgtgagtagtttggggtttagggggagctacaacgaggcaggcaggggcagcaaggatggtgttgacagacccaggtcttcatttctcctgttgctctggatctcgtggtgcctacggggacatcgtgatgagcctagttccagacctccctggctggtcgtcgtcgtcggggcgtacggtacgggaccctaaccctattaccgaaaccttcggaccgtaaacgggttcccgaacgggtcccgtaagggtaacggttttgtttttaccgtttaccggaccccctaacctaaaacgtaaaccgtaaccttacgttaacggtccgtttaccggggtaacccaaggtaccgaaggtaaacggtacgggacctacggtccccttaaccgttaaacctccgtacggtaacttttacccgtggggtacctttacccggtaccccggggtctaccggttaccccggggttacctaaccgtaccttacgacttcgggtaccacggggtcggggtaccttcggggaaccttacgttccgacgtcctaccgaacccgtacgtaccgaacgtacctaccgtacccgtacggaccgttaagggtcctaaggggtaacggtacggtcgggttacggggtaccgttaaacggttttactaccggtacggttaacttaacggtacctaaacgttactttttaaccgtttaaccgttttccgtttttcccggttacgttaccgggttttacccggggacggggtacgggtaacccggttaaggggggtacgaaccgggtattaacccggggaaaaccgtaaccgggtttgggtcggtacccggttcgacccttaccggttacttacccgtttcggttacccttaacggtacccg

SEQ ID NO: 43188 - DNA, 898 bp, Homo sapiens
  misc_feature: GYAE6OF01BZ4CC.31.14.B03.1.454.CMB.1.raw
tcagcagtagacgtcacgaccggtgctcgatttagtgtgagtagtttgggctgagcttgggttttcctcgttgctcttttaagaggtgtccagtgtcaggtgcactggtggaatcgtgggggagcgtggtccggcgtggggggtcctgagactctcctgtgccatgtctgcgtctagaattcatcctcaggcactagtggcagtgcctacggtcgggtcccgaccgacgggcccccaagggacgaaaggggcgtggggaggtcggggtgtactaagttttactaactaagtttagaagtaggaaagtaaaatttaaaaaacgtttcgacgtaagtaccgtacggtaggaacgggtaccgtaacttaccgaacctactcctaccgacgtaccgtaaccccttaccaacctactaccggtcttacgttactacctaacgtaaatacgtaaacgtacgttacgggtacgtaacgtaaggtttaacggaaaacgaaccgtaaccggttaaaccttaaacgtttttaaagtttaggttacgggttaacggtaaacgggttaaacgtttacgttttaccggggtttacgggtttaaccggtaacgtaactaacgttaacgttaaggttagggttaagggttaagggttacggggttaccggtaccgttaacccgggtaaccggttacccgggtacgggggtaacccggaaacgggttaaacccgtacggttaccgggtacccgttaacccgttcccgttacccgtacccgaaccggtacccctacccggtaacccgggaacccggtcccttaccgggttacccccggttcccccttacccccggtccgtacccccgttaccccccgtacgtaaccccgaaacggtccgtacccgttaccccggg

SEQ ID NO: 43189 - DNA, 894 bp, Homo sapiens
  misc_feature: GYAE6OF01CAEYO.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcacttatggcatgcacgtcggggtcccgaccgacggcccccgaagggaccgaaaggggacttgggagggttcggggtggcctaattttataactaagttttgaagtggtaaagtaaattaaaaaaaacgttttaccgacgtaacgtaaccgtaccggtaaggaacggggtccctaagttacccaacctaactcctacccgtaaggaccgtaccccttaccaaaccctagtaccgcttagtactcctaacctaaagtcgaaactagttcgggtacgtaactaggttaaggaaacgaaccgacggtaacttaaacgtttaattagtttggtacgtaacggtaaaagttcgtttacggttaggttaccgaaggtactacgtacgtaaagtcgggttaaggtacggttaaggggtcgtaccgttaacggaacccggtacgggttaccggggggacccggtaaaggggtaacccgtacgggttaccgggtacccgttaaccccggttacccgtttaccctaccggaaccccgtacccccgtaaccccggtaacccccggaaaccggggggtcccccttacccgggttcccccggggtttaacccccttttcccccccccgggtaacccgggttaccccctaacccccccgttccccggttaaacccccgaaacgggtccccccgttaaccccggtacccccggggg

SEQ ID NO: 43190 - DNA, 932 bp, Homo sapiens
  misc_feature: GYAE6OF01EB8PR.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcactatggcatgctacgtcgggtcccgccgacggcccccgaagggaccgaaagggccgttggggaggttggggtcggcttaattttaactaacgtaaagttttggaagttaggtaaaagtaaaactttaaaaaaaacgttttccgaactaacggtaccgttaccggtaagggtaaacgggcccgtaacgtttaccaaaccgtacttccgtacccaaggtaacccgtacccctttaaccaaacctacgttaccgtacttacgttaacctacctaaccaaaattacgaaacctagttagggtacgtaacgtaaggttacggaaacgtaaccgtaaaccgggtacttttaaaacttttaaggtttaaagtttacgggttaaacggtaacggttaaaacgtttacggttttaccgggttttagggtttaaccgtagtaactaagttacgtaaagttcgggttaagggtaaggttacgggtcggtaccgtaacccggtaaccggtaaccggtacgggggaacccggtaacgggggaaccctaccggttacggttaccgacccccggtttactaccccgtaccggaacccgttaccccctaacccggaaaccccggggtaaaccgggtacccccttacggtttaccccggttaccccccgttaccccccgtacgggtaaccccccccttaccccgttaacccccaacccggtaaccggtaacccggtcccgtaaacccccggggg

SEQ ID NO: 43191 - DNA, 727 bp, Homo sapiens
  misc_feature: GYAE6OF01EAEUO.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctggagctgggttttcctcgttgctcttttaagaggtgtccagtgtcaggtgcacctggtggaatcgtggggagcgtggtccggcctgggggtccctgagactctccgtgtgccatgtctgcgtctgaattcatcctcgaggcactatggcagtgcacgtcgggtcccnccgacggcccccaggccgaaggggactgggaggtgggtggctagtttaatactaagtttgagtaggaagtaattaaaaaattttaccgacagactacgtacgaaggccgtattcaccatccaccagaacgcccttacccaacctatacgcttagtactactaccaatcgaacagtgtagacaggttacgaacgaccacggacctaaactttattagttgtacgacgtaaagtatttccggttaggttacgagtctaataccgtaagttcgggttagggtaagtaggggtgtccgtaccgaaccgaccggtacggggaccgtaacgggtaaccacggttcggttacccgtacccgttccgtacccggtacctaaccgtccccgtaccgaaacccggtaaccgggccccgttaacggttccccgggttacccctttcccccccgggacggtacccccctacccccgtacccgtaacccgtaaccggtacccgtcccgttaacccccgggg

SEQ ID NO: 43192 - DNA, 884 bp, Homo sapiens
  misc_feature: GYAE6OF01B6196.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtccggccgtgggggtccctgagacctctctgtcgccatgtctgccgttctagaacttcatcctacgacggctactagtcggctagtcgacctacggtccgggtacccgaccgaccgggacccccgaggaccggtaaacgggccgttgggaggttcggggtgactttaagtttactaacgttaagttttaggaagttaggtaaacgttaaaactttaaaaaacgtttcgactaacgtaaccgttacggaggaaccgggtaccgtacttacccgaaccgtacgttaccgaccgaacgtaacccgtaccccttaccaaccgtactacgtactacgtacctacctaactaacgtactaacgtagttacgggactaaacgtacggttaacgaacggtaaccgtaacggtaactttaaacggtttacttagttaggaaccgttaacgtaacgtttacggttttccgggtaaggttacaacggtaccgttaaattacggtaaggtttacggggtaaggttaaggggttaccggggtaacgtcccggttaaccggaacccggtacggggtaaccgggtaaccgaacgggttacccgtaccgttcccgggtacccttaacccgttcccgtactaacccgttacccggaccctaaccccggaacgggtaccccggtcccttaaccggtcccccggtttccccgtccccgacccggtacccgtaccccctaccggtaccggaacccttccggacccgttaacccgggg

SEQ ID NO: 43193 - DNA, 702 bp, Homo sapiens
  misc_feature: GYAE6OF01DEB3Z.31.14.B03.1.454.CMB.1.raw
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtggggggtcctgagactctcctgtgccatgtctgcgtctgaattcatcctnaggcactatggcatgcacgtgggtcccncacggccccaggcaagggctggagtgggtgactatttanactaatttgataggagtaaattaaaaaatttcgacagtactaccggagaacggctattcgacctactctaccaggactaccccttacaaacctataccgtacgtactaactccttaaccgaaatacgaaacctaggttaggacgtaacgtaacggttagaaacgaaccgtaaccggtactaaaaccgttttatttaagttaggtacggaacgtaaaacgttacgttttccggttaggttcggaagtactaattaacgaggttaggttaggtaacgttagggtcgtacgaccgtacgaccgggttcgggaccgaacgggtaaccacggtcggtacccgaccgttcgtaccctcgtaacgcccgtaaacccgacggaaccggtccctacgttcccgtcccgttccccgtcgacccctacccgttacccaccgaacgtcgcccgtaccgg

SEQ ID NO: 43194 - DNA, 780 bp, Homo sapiens
  misc_feature: GYAE6OF01CGUBB.31.14.B03.1.454.CMB.1.raw
  modified_base (186)..(186): a, c, t, g, unknown or other
  misc_feature (186)..(186): n is a, c, g, or t
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcctggggggtccctgagactctcctgtgccatgtctgctctgaattcatcctnaggcactatggcatgcacgtcgggtcccnccacggccccaggcaagggctggaggtgggtgctatttactactaattgatggaataaattaaaaactttcgacagtaccgtcggtagaacgggcctattaccgacctatcctaccgacgaccgtaccccttacaacctataccgcttacgtaactactaccaaatcgtaacgagttcgggtataaccgtaggttacggaaacgtaccgacgggtaactaaagttttacttaagttgggtacggtaacgtaaaaggttcgtttacgggtttacgggttaccggaagtacgtaacgtacgtaagttacgggtaagggtaacgggttacggggtccgtacccggttaccgaaccgggtaaccccgggttggggaacccggtaaaggggtaaccttaccccgggtagggttaccccgtaaccccgttccgtaccctaaccggtacccggtccctaaaccccggacccgtaaaccggggtcccctacggttccccggttcccccttaccccccggttggacccccctacccgttaaccctacctaacggggccctccgtaacccccggg

SEQ ID NO: 43195 - DNA, 885 bp, Homo sapiens
  misc_feature: GYAE6OF01CWBJ8.31.14.B03.1.454.CMB.1.raw
  modified_base (863)..(863): a, c, t, g, unknown or other
  misc_feature (863)..(863): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtgggtccggcgtcggggggtcctgagactctcctgtgcctatgtcctgcgtctagtaattcactcctcgaacggtccaacgttagtcggacctagtcggacgtaccggtcggggtccccaccgaaccgggtcccccgaaggggaccgaaaagggggtccgtagggggtaggtgggggtacgtacttaaagttttactaacgttaaagtttgaagtaaggtaaagtaaaactttaaaaaagtttcggactaacgacgtacggtaacggacggtactactaccgtactactccacgaaccgtaccctaacctaaccaactacgtacgtactactaacctaaccctaagtaaactacggtaaactaggttaacggacgtaacgtaacggttaaacggaacgtacgtaaaccgtaactttaaacgttagttaagtacgggtaacggtaaacgttaaaccggtttaggtttacgggttacgtaacggtaaactactaagttacgtaagggtacgggttaaggtaacgggttcggacgtaccggtaccggtaacggtaccgggtaaccgggtaacggaaacggtacgtaaccggttacccggtaccgttactccccgtacgtaacccgccggttaaaccccaacccggtaacccgggtaacccggttacccgtacggttaccccccggttccgttaacccccgggcccttaaccccgttaccccgaaccctaaccgggaaccnccggttacccggtacccggggg

SEQ ID NO: 43196 - DNA, 693 bp, Homo sapiens
  misc_feature: GYAE6OF01ATH8Y.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggggaggcgtggtccggcctggggggtccctgagactctcctgtgccatgtctgcgtctgaattcatcctcaggcactatggcatgcacgtcgggtcccgccacgggccccaggcgaagggactgggagtgggtggctatttatactaatttgatggaataattaaaaatttcgatacgacctccgtagaacggcgtacttcaccgatcctaccagaccgtacccttaccaaccactacgcttagtactacctaccaaatacgaactagtggtacgaacgtagttaggaacgaaccgacggacttaactttattagttgtagtacgtaagttagtttcggttaggttacgagtactatactaagtggtaggtagtagggtcgtcctaggacctacgggttcgggaccgtagggaacctacgttccggtaccgacccgttactcccgacctaccggaccccttacccgaaacccgggtaacccggccccctaaggttccccgggttccccctttccccccggtccggaccccttaaccccccgtctaacccgaacggtcccgacccgtaccccggg

SEQ ID NO: 43197 - DNA, 558 bp, Homo sapiens
  misc_feature: GYAE6OF01BQ5GB.31.14.B03.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (549)..(549): a, c, t, g, unknown or other
  misc_feature (549)..(549): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcattttanacaatttgatggagaataaaaaaattttacgacaagactccgtagaagggccgattcaccatctccagagacccttcaacatacnctgatctccaaatgaacatggnacagttgaagacacggcaaacttattattgtgacgaaagattcgtggttacgagtcaatcaaatgtgatagggtgactcgacaccgtggggaccagggaacacgtggttaccacgtctcctcacgcctaccaccgaaggcccctaatccggtcttaccccccgtggaccctaaccctccctaccaaagngcctacccg

SEQ ID NO: 43198 - DNA, 795 bp, Homo sapiens
  misc_feature: GYAE6OF01EX27B.31.14.B03.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcgtgggggtccctgagactctcctgtgccatgtctgcgttctagtaacttcacttcccgtnacggtcacttagtggcagtcgcctacgtcgggtcccnccgacggccccaggtacgaagggcgtgggaggttgggtgctaattttanacttagtttgagtaggtaagtaaattaaaaatttcgacagtacgtaccggtaggtaacggccgtacttcacctactccgtaccgagtaccgtaccccttaccaactactaccggtactacgtactcctaaccaaagtacgaacgtagttacgggacgtaacgtaggtagaaacgtacgtaacggtacttaacgtttacgtttaagtacggtacgaacggttaaagttacgtttccgggttacggtacgtacgtaactaaggtcgtaaacggttggggtacggtagggttccgggtaggtcccgtaaccggtaaccggccggggttacggggacccgtaacggggtaaccgtacggttccggtacccgtaacccgttcctaccgttaccgaccgtaccccgtaaccccggaaccgggtacccgtcccgtaccggtttccccggttaccccttacccccgggcgtaacccctccccggttaacccaccgtaagggtccccgtccgtaaccccggg

SEQ ID NO: 43199 - DNA, 626 bp, Homo sapiens
  misc_feature: GYAE6OF01A7I3N.31.14.B03.1.454.CMB.1.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaatttcatcctcaggcactatggcatgcacgtgggtccnccacggcccccaggcgaagggactgggaggtgggtgctagtttanactaatttgagtggaagtaataaaaatttcgacagactccgtaggaaggccgattaccactatctaccagacgtacccttaccaaccatacgctagtactaccacctaatagaactgtggtagacgtaggttagaacgacgacggtactaaacttattagttgtagacgtaaagttctttcggttaggttcgagtctatactaagtggtaggtagtagggtcgacgtcgacgaccggtgggaccgaagggactacgtcggtacctacgtcctcctcgacnccccgtaccgaccgacggtccctacggtcccggttccctccccgtgacccctacccctaccctaccgaacgtccgccgtacccgg

SEQ ID NO: 43200 - DNA, 860 bp, Homo sapiens
  misc_feature: GYAE6OF01C9W4O.31.14.B03.1.454.CMB.1.raw
  modified_base (582)..(582): a, c, t, g, unknown or other
  misc_feature (582)..(582): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggaggcgtggtccggccgtgggggtcctgagactctcctgtcgccatgtctgcgtctagtaattcacttccctacgaggcaactagtggaccagtcgcctacggtcgggtcccgaccgacggccccgaaggacgaaacgggacgtggggaggtgggtcgtacttaagttttaacaacgttaagtttgagtaggtaagtaaaatttaaaaaagttcgactacgtaccgtcggtaggaacggtaccgtataccacctatcctaccgacgacctaacccttaccaaactacgtacgcttagtaccttacctaaccaaagtcgaaacgtagtcggtaacgacgtaggtaacgaaagaccgtaacggtacttaaactttagttacgtaggtaacggaactaagttacgtttggtaggtaccgaataccgtaataggaagttagggtagggtaaaggttaccggggttnacccgttaacggacccggttaaccgggccggggaacgtaaagggggtaaacctcccgggttaacggttacccctacccggtttaccctaccgtaccccggtaagttacccccggaacccctaaaaccggggtaacccgggttcccccggtaacctttcccccggggttttaacccccccgtttccccccgggaaaccggttaccccccccttaaaccccggtttaaccccgaaaccggtaaaacccggttcccgggtaacccctttaaccccgggggg

SEQ ID NO: 43201 - DNA, 711 bp, Homo sapiens
  misc_feature: GYAE6OF01A6BB3.31.14.B03.1.454.CMB.1.raw
tcagcagtagacgtcacgaccggtgctcgatttagtgtgagtagtttgggctgagctgggttttcctcgttgctcttttaagaggcgtccagtgtcaggtgcacctggtggaatctgggggaggcgtggtccggcctggggggtccctgagactctcctgtgccatgtctgcgtctgaattcatcctcaggcactagtggcatcgctacgtgggtcccgccgacggccccagggcgaagggctgggaggtgggtgctatttataactatttgagtaggtaagtaaattaaaaagttttcgactagtacctccggtaggaacgggcctattacacctatcctaccacgaccgtacccttaccaacctataccgtctgtactactaaccaaatacgaactagtaggtacgatagtagaagacgacggtactaacgtttattagttagtagaacgtaagttgtttacggttcggtacgtagtctaattacgaagttgggtaggttagtacggggtcgtaccgttacgaccgtaccggggtacgggaccgggaacgggtaacctacgggttacggtacccgtacccgttcctacccctcgtacccgtccctaacccgaccggtaacccggccgttacccgttcccggtcccccttaccccccggtcgacccctacccccgtaccctaccgaaccggtaccctccggtaccccggg

SEQ ID NO: 43202 - DNA, 794 bp, Homo sapiens
  misc_feature: GYAE6OF01B7QEL.31.14.B03.1.454.CMB.1.raw
tcagcagtagacgtcacgaccggtgctcgatttagtgtgagtagtttgggctggagctgggttttctcgttgctctttaagaggtgtccagtgtcaggtgcacctggtggaatcgtggggaggcgtggtccggcgtcgggggtccctgagactctcctgtcgccatgtctgcgtctgaattcatcctcgaggcactagcggcagtcgcacgtcgggtccgaccgacggcccgaggacgaagggtacgtagggacgtggggttgctaattttacactaagtttgaagtaggaaagtaaattaaaaaacgtttcgactacgtactcggtacggaacggcgtacttaccgacctctaccctcgacgaccgtacccttaccaacgtataaccggtctagtactaccgtaacaaacgtacgaacgagttggacgtaactaggttacgaacgtaccgtacggtaactaagtttagttaagttaggtacgaaccggtaaagttacgttttcgggttacggttacgaacgtacgtaagttaacgtaaggttccgggtaaggttacgggttaggggtaacgttccggtaacggtaccggtaaccgggttccggggtaaacgaacggggtaaaccttccgggttaacggttccaacccggtttccccgtaacctcccgggtaacgttaccccgtaaacccgaaccgggttacccggccccgttaacggttcccgggttccccccttacccgtcccgggaccctttacccccgccgttaaccgtacggccgtaacccgtacccgg

SEQ ID NO: 43203 - DNA, 727 bp, Homo sapiens
  misc_feature: GYAE6OF01D4ZG2.31.14.B03.1.454.CMB.1.raw
  modified_base (272)..(272): a, c, t, g, unknown or other
  misc_feature (272)..(272): n is a, c, g, or t
  modified_base (510)..(510): a, c, t, g, unknown or other
  misc_feature (510)..(510): n is a, c, g, or t
  modified_base (525)..(526): a, c, t, g, unknown or other
  misc_feature (525)..(526): n is a, c, g, or t
  modified_base (551)..(551): a, c, t, g, unknown or other
  misc_feature (551)..(551): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggaggcgtggtccggccgtggggggtccctgagactctcctgtgccatgtctgcgtctgaattcatcctcaggcactatggcatgctacgtcgggtcccgacgaccggccccgaggcgaaaggggcgtgggaggtggggtggactattttaanactaagttttgagtaggaagtaaaattaaaaaaacgttttaccgacaacgtaccgtaccggtaggaaacggggccctaatttaccaacctagttcctaccgaaggtaaccgaccccctttaaccaaacctaagttaccgacgttacgttaactaccttaaccaaaagttcgaactagtggtacgactaggttacgaaggaacacggactaactttaatttgttagtgaacgtaaagtntttggttggtacgannaatacaagtggtaggtaaggtgggngtaccgtacggaccgtacgggcggggaaccgaagggtaacctacgttcggtacctacccgtactcctcgaccgacccgtacccaacccggtaccgggcccctaaccggttccgttccccgttccccccgtcggacccctccccttaccctacccggaaagcccgtcgtaccccggg

SEQ ID NO: 43204 - DNA, 751 bp, Homo sapiens
  misc_feature: GYAE6OF01A0N3I.31.14.B03.1.454.CMB.1.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (369)..(369): a, c, t, g, unknown or other
  misc_feature (369)..(369): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatgacatgcactgggtcccnccgacggcccccaggccgaagggactggaggtgggtgctatttanactaatttgatggaagtaattaaaaaattttcgcagactccgtagagggccgattcaccatctaccagacgacccttccaaccatacgctgtatctacaatgaacatggngacagttagaagtacgacggactaaacgtttattagttacgttagacggtaaagtcgtttacggtttgggttaccgaagtctaacttacgtaaagttcgggtagggtaacgtttaagggggtcggtaccgtaccggtaaccgacccgggttacggggggacccgtaaagggggaaaccccgtacgttaccgggtaccctaaaccccggtttccttaccccgtccgaacccgtccccgttaaccccggaacccggaaacccggggccccccttaaaggttcccccgggtttccccccgtttacccccccgttacggccccccgttaaaccccccgtcccttaaaccccccggaaacggtacccgggcccttaaccccccgggg

SEQ ID NO: 43205 - DNA, 711 bp, Homo sapiens
  misc_feature: GYAE6OF01DWVHG.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtggggaggcgtggtccggccgtgggggtccctgagactctcctgtgccatgtctgcgtctgaattcatcctcaggcactagtggcatgcacgtcgggtcccgccgacggccccgaggcgaaagggacgtgggaggtggggtgactaatttactactaatttgagtaggaaagtaaattaaaaaatttcgacacgtacgtccggtaggaacggccgtattcacctatcctaccgagaccgtacccttaccaacctataccgtctacgtactacctaactaaatacgaactacgtggtagacgtaagttagaacgacgacggtaacttaaacgtttatttaagttagtagtaaccgtaaagttacgtttcggttaggttacgatactatactaaagtggtaggtaagtgggtcgaccgtacgactacgggtacgggacgtaacgggaccgtacggtcggtacctacccgtccttcccgtaccaccgtccccgtacccgaaccggtaaccggtcccctacggttccccggtttacccccttccccccgtacggaccccctaacccctacccgtaaccaaccggcgtccccgtaacccgg

SEQ ID NO: 43206 - DNA, 906 bp, Homo sapiens
  misc_feature: GYAE6OF01CZ6F9.31.14.B03.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
tcagcagtagacgtcacgaccggtgctcgatttagtgtgagtagtttgggctgagctgggttttcctcgttgctcttttaaagaggtgtccagtgtcaggtgcacctggtggaatcgtgggggaggcgtggtccggccgtggggggtccctgagactctcctgtgccatgtctgcgtctgtaattcatcctcgaggcactagtggcatcgcacgtcgggtccnccgacggccccaggacgaaagggtatgggaggtgggtgactatttaanaacgtaatttgaagtaggaaagtaaaacttaaaaaaagttttacgactaacgtaaccgtccggtaggaaacgggcctaacttaccaacctacttccctaccaacgtaaccgtaaccccttaccaaacctacgtaccgtctacgttaactcctaaccaaagtacgtaaaccaggttaggtacgtaacgtaaggttaggaaacgtaaccgtaacgggaaccttaaagtttaatttagttacggtacgtaaccggtaaaagttacggtttacgggttacgggtaacggtagtaactaagtaacgtaaaggttcgggtaagggtaaccgttaggggtacgtaccgtacccgggaactaccccggggtacgggggaacccgtaaaggggaaccctaccgggttaccggtacccggtaacccgttcccggttaccccgtacccggtaaccggtacccccgttaaaccccccggaaacccggtaaaccccggggtccccccgtttaaccggtttaccccccggggtttccccccttttaacccccccccccgggtcgggtaaaccccccccttacccccccgttaaccccgttaaaccccgggaaaccggttaccggacccccccgtttaaaccccgggggg

SEQ ID NO: 43207 - DNA, 740 bp, Homo sapiens
  misc_feature: GYAE6OF01EZYPH.31.14.B03.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccacggccccaggcaagggctgggagtgggtggctatttanactatttgataggaanaattaaaaatttcgacagactccgtagaaggccgtatcaccactcctcgagtaccgtacccttaccaacctataccgctagtactcctaacaaagtacgaacagtggtacgtaacgtagttaacgaaacgaaccgaacgggtacttaaactttaagtttaacgttggtacggtaaccggtaaaaggtttacgtttaccgggtttaggggtttaccgaaggtaccgtaacttacgtaaacgttgggtagggttaaggtacgggggttcggaccgttaccggaaccgtacccgggttagggggacccgaaacggggtaaccctacggttcgggtaccctaaccgttccctaccgtccacggtccctacccgaaccggtaacccgggcccttaaccggtcccggtttcccccttaccccggtccggaccccctacccctacccgtacccgaaagcccgccctaacccggg

SEQ ID NO: 43208 - DNA, 827 bp, Homo sapiens
  misc_feature: GYAE6OF01A79Q9.31.14.B03.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgtctgaattcatcctnaggcactatggcatgcacgtgggtccnccacggcccaggcaagggactggaggtgggtgactagtttanacgtaatttgaagtaggaagtaattaaaaattttcgactaagacctccggtaggaacgggccgtaattccgaacctatccgtaccgaagaccgtacccttaccaaccactacgactgtactactaccaaatcgaaactagtggtagtaacgtagttagaacgtaccacggtactaaactttagttacgttagtacgtaacgaaagttcgtttacggtttacgggttaccgaagtacctaacgttacgtaaaggttcgggttaacgggtaaggttacggggttacggtaccgttaccgggtaaccgtaacccgggttacgggggaacccgtaaacgggggttaaacccgtacgggtttacccgggttacccgttaaccccggtttacccgttaccccgtacccgtaaccggtacccccgttaaccccggaaaccccgggtaacccggggtaccccgtaaccgggtttcccccgggttaccccccgttttaccccccggacggtacccccttaaacccccccgttccggttaaaccccgaacggtacccggtccccgttaaacccccgggg

SEQ ID NO: 43209 - DNA, 782 bp, Homo sapiens
  misc_feature: GYAE6OF01ACVQK.31.14.B03.1.454.CMB.1.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagcgtggtttcctcgttagctctttaagaggtgtcagtgtcaggtgcactggtggaatcgtgggggaggcgtggtccggccgtggggggtccctgagactctcctgtgccatgtctgcgtctgaattcatcctacgaggctactagtggacatgctacgtcgggcccnccacggccccagggcgaaagggtctggggagtgggnggtctaagttttacaactaagttttgagtagggaataaatttaaaaaacgtttcgacacgtacgtccgtaaggacggggacctattaccactactcctaccgagtccgtacccttaccgaacctactacggcttacgtacttacctacctaaagtacgaactaggtggtacgaacgtaggtaaggaacgaccgacgtaccgttaactttagttacgttaggtcgaacgttaaaggttcggtttggttacgttacggacgtactatacgtaagtgggttaggtacgggtagggtacggtccaccggtacgaccgggtcggggtaccaacgggtaaccgtccggtaacggttccccgaccgttcccgtcccttacggaccccgtccctaaacccggaacccggtaacccgggacccgttaccggtttacccccggttcccccgttccccccggggtactaacccccccggttcccccttaccccgaaacccggtacccgggtaaccgtaccccggttaccccggggg

SEQ ID NO: 43210 - DNA, 738 bp, Homo sapiens
  misc_feature: GYAE6OF01BATXS.31.14.B03.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtnccatgtctgcgtctgaattcatcctgaggcactagtggcatgacacgtcgggtcccnccgacggccccaggcaaagggctgggagtgggtgactatttanacaatttgagtaggaataattaaaaacgtttcgacagtaccgtacggtacggaacgggtccgtattaccacctactacctaccgacgtaccgtacccttaccaacctanacgtctacgtactactacctaaancgtaacagtaggtagactaggtacgaagtacgacggtactaacttagttataggtagacgtaagtcgttcggtacggttacgacgtactagtactagtggtaagggtacggttagggtacgtacgtccggaacacccgggtacggggaccgtaacggggtaacctaccgggttcggtacccgtcccggttaccgtccctaccggacccgttaccccctaccggtaaacccgggaaccccgggtcccccttaacgggttcccccggttaccccgttccccccggtacgtaccccccttacccccgttcccgtaaacccggacccgtacgtaccccgtacccggg

SEQ ID NO: 43211 - DNA, 703 bp, Homo sapiens
  misc_feature: GYAE6OF01DAWKF.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtggggggtccctgagactctcctgtgccatgtctgcgtctagaattcactcctcaggcactatggcatgcacgtcgggtccaccgacggccccaggaccgaagggcgtgggagtgggtgtactatttagactaagtttgagtaggaagtaaattaaaaatttcgactagtaccgtcggaggaacgggtcctattaccacctatccaccgaagtaccgtacccttaccaacctataccgtcttagtactacctaactaagtacgaaactagttaggacgtaacgtaggttacgaacgtacgaacggtactaaagtttactttagtagtacgtacgtaaagttcgtttacggttaggtacgagtactaagtactaagttggtaggtacgttagggtcgaccgttacgacgtacgggtcgggaacgacgggtaacctacggtcggtacccgtaccgttcctaccgtcgaccgtccccgtaaccgaaccggaccgggtccctacggttcccggttcccctaccccggtcgtaccccctacccgtaccctacgaaccgtcgcccggtaccgg

SEQ ID NO: 43212 - DNA, 654 bp, Homo sapiens
  misc_feature: GYAE6OF01BY60X.31.14.B03.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggctggggggtccctgagactctcctgtgccatgtctgcgtctgaattcatcctcaggcactatggcatgcacgtgggtcccnccaggcccccaggcaagggactgggagtgggtggctattttanactaatttgatggaataattaaaaatttccgctagactcggtagaacgggccgattacgacctatctaccagacgtaccctaccaaccatacgctagtactctaacctaaatgaactagtggtagacgtagttagaacgacgacggtactaaacgtttattacgttaggtagtaaccgtaaagttacgtttacggtttaggttaccgagtacgtaactacgtagttggtaggtaggtagggtcgccgtcgacgtaccggtgggaccgaagggaaccacgttacggtacctaccgtctacccgaccgtacgtccctaccaccgaaccggtccctgttacccggttcccctccccgtacggcccctacccctaccgtacctaacggcgtccctaccggg

SEQ ID NO: 43213 - DNA, 693 bp, Homo sapiens
  misc_feature: GYAE6OF01EME1X.31.14.B03.1.454.CMB.1.raw
  modified_base (188)..(188): a, c, t, g, unknown or other
  misc_feature (188)..(188): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggctggggggtccctgagactctcctgtgcctatgtctgcgttctgaattcatcctnaggctatagtggccattcgctacgtcgggtccnccgacggcccaggacgaagggtctggagtgggtcgctatttacactagttgagtaggaataacttaaaaacgtttcgactagtaccgtccggtaggaacgggtcctacttccgacctactaccgtaccgaaggtacccgtaccccttaccaacctacgttaccgtcgttacgttaactcctaaccgtaaagtacgaaactacggttgtaccgtaacgtaggttaacgaacgtaccgtacgggtacttaaacgtttattacggttcgaaggtaacgtaagttacgtttcggttaggtcgatctactagagttggtaggtagtcggtcgccgtacggaccgtacgggcgggaccgtaacggtactcggtacgttcctaccgttcctaccgcgtacgtccctaccgacgaccggtcctacgttccgtaccctcccggtagcccctaccggtacctacgaacgtcgtacccgtcgg

SEQ ID NO: 43214 - DNA, 717 bp, Homo sapiens
  misc_feature: GYAE6OF01EJ71I.31.14.B03.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (461)..(461): a, c, t, g, unknown or other
  misc_feature (461)..(461): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactcgggtccnccacggccccaggacgaagggtactgggagttgggtggactattttanactatttgatggaagtaattaaaaattttcgatacgactccgtagaacgggcctattccacactctaccagacgaccttccaacatacgctagtatctacctaaatagaactagtgtacgactagttacgaacgacgacggtactaacgtttattacgttcgtacgtaacgtaacgttacgtttcgttaggtttacganactaactcgtaaaggttggtaggtaacgttacgggtcggtaccgtacgtaccaccgggttacggggaccgtaacgggggtaaactaccggtttcgggtacccttacccgttacgttccctaccgtaccgtaccccttacccgaacccgtaaccggggtcccctaaggttccccggtttaccccgttccccccggttacggtcccccttaaccccgtaccccgttacccgaaaccggtccgtccccggtaacccggg

SEQ ID NO: 43215 - DNA, 783 bp, Homo sapiens
  misc_feature: GYAE6OF01AOVVO.31.14.B03.1.454.CMB.1.raw
  modified_base (269)..(269): a, c, t, g, unknown or other
  misc_feature (269)..(269): n is a, c, g, or t
  modified_base (736)..(736): a, c, t, g, unknown or other
  misc_feature (736)..(736): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtcgggtcccgccgacggtccccaggacaaaggggactgggaggttgggtggactaattttanaactaagttttgaagtaggaagtaaattaaaaaattttcgacgtaagacgtccgtaggaacgggccgtattaccacctacgtcctaccgaacggtaccgtaaccccttacccaaacctacgtaaccgtacttagttactacttacccgaaaatacggaaactaagttgggtacgtaacgtaaggtttacgaaacgtaacgacggtacctaaaacgtttacttaaagtttacggtacgtaacgtaaaagttactttcggtttacgggttaacgaacggtacaattacgtaaagttgggtacgggtaagttacggggtcgtaccgtaacgaccgtaccgggtacggggtaacccgaaacggggtaacctacccggttggtaccctaacccggttccgtacccttacgaccgtacccgtacccgaaacccgtaaccgggtccctaccgttcccggttcccttacccccgnggtacccctaacccgttcccctaagtaacgaccgtccgtaaccccgg

SEQ ID NO: 43216 - DNA, 825 bp, Homo sapiens
  misc_feature: GYAE6OF01BEOY0.31.14.B03.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggctactagtggcatcggctacgtcgggtccnccgacggcccaggcgaaagggctgggagtgggtgctatttanatagttgagtaggaagtaaattaaaaacgtttcgactaacgtacgtccggtaggaacggtcctagttaccaccgtaactccgtaccgaacgtaaccgtacccctttacccaaaccgtaagttaaccgtacttacggttaactaccgtaaccgtaaaacgtacgaacctaaggtagggttaacgaacgttaaggttaaacggaaacggtaaccgtaacggtaaccttaaactttaagtttaacgttaggtaacgggtaaccgtaaaagtttccgtttagggttacggttacgagtactagtacgtaagttgggtaagtaggtaggtacggtactacggacccgtacggtacggggaacccgaagggtaccgtaccggttacgggtccctaacccggttcctaccgtaccgaccggtaacccgtacccgtaaacccgggtaccggtaaccccgttaccgggttaccccgttacccccgtttacccccccggtaggaccccccttaacccccggtacccccttaaaaccggaaccgtaacccgggtccccttaaccccggggg

SEQ ID NO: 43217 - DNA, 859 bp, Homo sapiens
  misc_feature: GYAE6OF01EDZWS.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggtcccgccgacggccccaaggacgaaggggactgggaggttgggtggtacctaagttttaactaacgtaaagttttgaagttagggaaagttaaatttaaaaaaacgttttcgaacgtaacgtaaccgttaccggtaaggtaacgggtaccccgtaacgtttaccaaaccgtactttacccggtaacccgtaacggtaacccggtaaccccttttacccaaaaccctaacgtacccggtaccttacggttaaacttaccgtaacctaaaagttaacgaaacctaaggttacggtaacggtaacgtacggtttaaacgaaacggtaaccgtaccggtaaactttaacgtttaagttttaagttacgttaggtaacgtaaaagttcggtttacggtttggttacggtaagtacctaagtacgaaagttgggttagggtaagttacggggtacgccgttaccggtaaccgaccgggtacggggaccgtaacgggtaacgtaaccggtcggttacccacccgttactcccgacgtacccgtacccgtaacccgaaccggtaccgggtccccttaacggttcccggtccccgtttccccgaccggtacccctaccccgtacccttaccggaaacgtaccgtcccgtaaccccggg

SEQ ID NO: 43218 - DNA, 770 bp, Homo sapiens
  misc_feature: GYAE6OF01DVEVT.31.14.B03.1.454.CMB.1.raw
  modified_base (215)..(215): a, c, t, g, unknown or other
  misc_feature (215)..(215): n is a, c, g, or t
  modified_base (534)..(534): a, c, t, g, unknown or other
  misc_feature (534)..(534): n is a, c, g, or t
  modified_base (638)..(638): a, c, t, g, unknown or other
  misc_feature (638)..(638): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctgggggtccctgagactctcctgtgccatgtctgcgtctgaattcatcctcaggcactagtggcagtgcacgtgggccnccacggccccagggcaaaggggactgggacggtgggtacgctaagtttatacgtaattttgagttagggaagtaaatttaaaaaactttttacgacgaagtaaccgtccggtagaaacgggccgtattaccaacctactcgtaccgaggaaccgtaccccttaccaacctaactacgtactacgtaactcctaaccaaaatcgaacctatagggtacgaacgtaagtttacgaacggtacgaccgggtacttaactttaactttaagttcggttagaaccgtaaaagtacgtttttcgggttacggtttacgaacggtntaaacgtacgtaaggtttggtagggttagtaacggggtcgtaccgtacggaacccgtaccgggttgggaacccgaaacggggtaacctacgttcgggttaaccnccgtttacgccctacggtaaccgtccccgtaaccgacccggaacgggtcccctacggttcccgggttacccccttcccccgtacgggccccctaccccttacctaacccgtaaagcccgtccgtaccccggg

SEQ ID NO: 43219 - DNA, 848 bp, Homo sapiens
  misc_feature: GYAE6OF01E15YB.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgctatttatactaagtttgagtaggtaagtaattaaaaaacttttacgactaagtaaccgtccggtaaggaacgggaccgtacttaccacctactacctaccgaggtaccgtaacccctttacccaaacctaactaccgtacgttacgtacttacctaacctaaaacgtacggtaaaccgaagttcgggttacggaacgttaaggttacgggaaaacgacccgtaaaccgggtaccttaaacgtttaacgtttaatttacggggttagtaaccgggtaaacggttacgttttaccgggtttacgggtttaaccggtacggtacctaagtaaccgttaaaggttacgggttaagggtaacggttaaagggggttcgggtaccgtaccggtacggtacccgggtacgggggaccgtaaacggggaacctacgggtacgttaccgtacccgtcgttaccccgtacaccggtccctaaccccgaaccggtaaaccccgggtccccgtaccggttaccccgggttcccctttaccccccggtaccggtaccccccgtaaccccgttacccccggttaaccgaaaccgtacccggtccgttaaccccggg

SEQ ID NO: 43220 - DNA, 773 bp, Homo sapiens
  misc_feature: GYAE6OF01CXFY7.31.14.B03.1.454.CMB.1.raw
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgttggtccggacctgggggtccctgagactctcctgtgccatgtctgcgtctgaattcatcctnaggcactatggcatcgcacgtgggtccnccacggccccaggacaagggctggagtggtgctaattatacatttgatggaagtaattaaaaaattttcgacaagactccgtagaacggccgaattcgaaccagtcctccgaagtacgacccctttacaaaccacgttaacccgacttagtaactcctaaccaaaagttagaaaccgtagttcgggtacgtaccgtaaggtttacggaaacgtaccgtaaccgggtacttaaaaccgtttatttaacgtttacggtaggtaaccggtaaaaggttcgttttacgggtttagggtttaccggaaggaccttaaagtaccgtaaagttcggtagggttaacgtaaggggtcggtaccttaccggaaccgtacccggttaagggggacccgaaagggtaaacctacgggttggttacccaaccgtttaccgtcccgtaacgtaccgtacccctaacccgaaccggtaaccgggaccccgttaattcccggttaccccttcccccggtgggaccccttacccccgttacctacccgaaaccgttcgaccccttaacccggg

SEQ ID NO: 43221 - DNA, 626 bp, Homo sapiens
  misc_feature: GYAE6OF01B5SGR.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccaggccccaggcaagggctggagtgggtgcatttanacatttgatggagataaaaatttcgcagactccgtgaagggtccgattcaccatcctccagacgtacccttccaaaccagttaccgctagtactcctaccaaatcgaaacagtggtagactagttagaagacacggactaacttattagtgtagacgaaagtattcgttggtacgagctatcaattggtaggagtagggtgctacggacaccgtggggccaaggggaacacgttgggtacctaccggttcctaccgtccgacgtcccgtacccgaaccggaacgggtccccctaggttccccggttccctttcccccccgtgggaccccctaccccttccccgtaacccgaacgtaccgtccccgtaaccccgg

SEQ ID NO: 43222 - DNA, 651 bp, Homo sapiens
  misc_feature: GYAE6OF01DSKZC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccgccacggcccccgaggccgaaaggggactgggaggtggggtggctattttatactaatttgataggaagtaattaaaaaaattttacgacaagacctccgtaggaacgggccgtattcaccatcctccagacgtaccccttaccaaccataccgtctacgtatcctaccaaatcgaaactagtggtagactaaggttagaagacacggactaaactttatttagttagtagacggtaaagtgtttacggttggttcgagtactaatactaagttggtaggtagttaaggggtgtccgtacgaccgaccgtcggggaccgaagggaacctacgtcggtccgtacccgttctcctcaccgtccacccaccgacggccctagttccggttccctcccccgtgaccctcccctacccgtaccaacgccgtcctacccgg

SEQ ID NO: 43223 - DNA, 951 bp, Homo sapiens
  misc_feature: GYAE6OF01CSFRC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtcccgccgacggccccgaggacaagggactgggaggtgggtggctatttatactaagttttgagtggaagtaattaaaaaaaacgttttacgacaagtaccgtaccggttaggaacggggtcccgtaattaccaaccgtaacttcctaccgaagtaaccgtaacccccttttaacccaaaccctaacgttacccggtaccgttacggttaacttccctaaaccgaaaacgttacggaaaacctaacggttagggttaacggtaacgtaacgggttttaacggaaacgtaaccgtaaaccgggtacctaaaaccgttttaagtttacgttaggttacggtaaacggtaaaacggttacgttttccgggtttagggttacggaaacgtcgtaaacttacgtaaaggttcgggttaagggtaagggttagggggttacgggtaccgttaaccggtaacccgtacccgggtacgggggtaaccccggaaacgggggtaaacccgtaccggttaccgggttacccgtaaccccggtttacccgttcccgtaacccggtacccggtaacccccgttacccgaaaccccgggtaacccggggtaccccccgtaaacgggtttcccccgggtttaccccccggttttaccccccgggtaccccggttacccccgttaaaccccccctaccccccggttaaacccgaaacccgggttacccggtaacccccgtttaaaccccccggggg

SEQ ID NO: 43224 - DNA, 972 bp, Homo sapiens
  misc_feature: GYAE6OF01EIUR3.31.14.B03.1.454.CMB.1.raw
  modified_base (204)..(204): a, c, t, g, unknown or other
  misc_feature (204)..(204): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtcccggccgtggggggtccctgagactctcctgtgccatgtctgcgtctgaattcactcctcgaggcactagnggcatggcacgtcgggtcccgccgacggccccgaggacgaagggacgtgggtaggtggggtggcttaagtttaatacttaatttagagtaggtaaagtaaaatttaaaaaagttttacgacgtaacggaccgttaccggtaggaacggggtacccgtaacttcccaaccttacgttacccgtacccgaacggtaacccgtaaccccctttaacccaaaccctaacgttaaccggtaccttacgttaaacttaccctaacccgtaaaacgttaacggtaaaccgtaacgtacggggttaacgaaccgttaaggttaaacggaaacggtaaccgtaaacccgggtactttaaaacgttttaagtttaacgttaggttaaggtaaccgtaaaaggtttacggttttcggggttttacgggttaacgtaacgttaactaacgttacgtaaagggttagggttagggttaaggggttacgggtacgggtacccgttaaccggtaaccccggtaccgggggttaccgggggaaacccggtaacgggggtaaaaccctcggttacccgggttaccctaacccccggttcgtaaccccgtccggaaaccccggtcccccgtaacccggtaaaaccccggtaccggggtaaccccccgttaggtttacccccccggggtttcccccctttaccccccccggggtccgtaaccccccccgtaccccctttaaccccgtacccccggtaaacggccccggttcccccgtaaacccgggg

SEQ ID NO: 43225 - DNA, 714 bp, Homo sapiens
  misc_feature: GYAE6OF01CSSZJ.31.14.B03.1.454.CMB.1.raw
  modified_base (83)..(83): a, c, t, g, unknown or other
  misc_feature (83)..(83): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggttttcctcgttgctcttttaagnggtgtccagtgtcaggtgcacctggtggaatcgtgggggagcgtggtccggcgtggggggtcctgagactctcctgtgccatgtctgcgtctgaattcatcctcgaggctaactagtggaccatcgcacggtcgggcccncgacggcccagggacaagggctgggaggtgggtgactaatttanaactaagtttgaagtaggaaagtaaattaaaaaactttcgactagtaccgtaccggtaggaacgggtacctaattccaacctacttccaccgaacgtaacccgtaaccccttaccaaactactaccgcttagtaactacctaaaccaaagttacgaaactaggttacggtaactaacgtaaggttaagaaacgtaacccgtaacgtaaccttaaagtttagttaacgttaggaacgtaagtaaagttacgttcgggttagtacgaagtactaagtacgtaagttgggtaggtaacggtagggtcgtaccgtacgacgtaccgggtcgggaactaaggacctacggtcgtaccaccgtcaccgtacgcaccctaccgaacgaccggtacctcgttacccgtcccttcccgacgtacccctaccgtacaaccgaacgcgcccgtacggg

SEQ ID NO: 43226 - DNA, 897 bp, Homo sapiens
  misc_feature: GYAE6OF01AE0LW.31.14.B03.1.454.CMB.1.raw
  modified_base (628)..(628): a, c, t, g, unknown or other
  misc_feature (628)..(628): n is a, c, g, or t
tcagcagtagacgtcacgaccggtgctcgatttagtgtgagtagtttgggctgagcttggttttcctcgttgcttcttttaagaggtgtccagtgtcaggtgccaccgtggtaggaattcggtggggggaggccggtcgggtcccggccggtcggggggtccctgagtcctcctccgtgtcgcctagttcgtccgtcggccgttactagtaacttccacttcccgacgacggcctaagttagcggactagtcgccgtaccggtccgggccccgacccgaccgggaccccgagggaccggaagggtcggtagggtagggttcgggtactaactttaagtttaacgtaattaagtttagaacgttaaggtaaaacttaaaactttaaaacggttcgacgtaccggtaaccgttcggtagggaaccggtctaacgtccctaactacgtccaaccgtacgtaccccttaacccctacaacctacgtccgtacttaccgtacctaacgaaacgtaacgtacgtaacgtaggtacggaacgtaacggtaaggtaacgaaccgttaaccgtaacgttaacttaagtttagttacggtacgtaacgtaacgttaggttccgtttagggtaccgtanaacgtacgttaagttaccggaggttgggtaaggtaccggtacggtaccgtaacccgtacggggaacccggtccgggggaacggtacccgttaacgacccggttcggttacccccgttacctcccgttaccacccgttacccgaccccgtacccggtaccccgtaccgggtcccccgtccgtttccccggttacccccgttccccctaacccccgtcgtacccccccaacggtccccgttaaacggccggtaccgtcccgggtacccggg

SEQ ID NO: 43227 - DNA, 770 bp, Homo sapiens
  misc_feature: GYAE6OF01D33SK.31.14.B03.1.454.CMB.1.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtcccggccgtggggggtccctgagactctcctgtgccatgtctgcgtctgaattcatcctnaggcactatggcatcgcacgtcgggcccnccgacggccccaggacgaagggctgggaggtgggtgactatttanactaagtttgagtaggaagtaaattaaaaaacgtttcgactagacctccggtagaacgggcctattaccacctatccaccgaggtacctaccccttaccaaacctataccgtctagtaactactaactaaaagtgaaactagtaggtacaacgttagtaacggaacgtaaccgtaccggaacttaaactttaatttacgttggtaacgtaacggttaaagttccgtttacgggttgggttaacgacgtacctagttaacgtaaggttcgggttaagggtaagggttggggacggtacctaccgggaaccgtaccgggtacggggaccgtaagggtaaccgtaccggttcggtacccgtacccgttcctacccgtacgaaccccgtcccgtacccgaaacccggtaccggtcccgttaccggttccccgttacccccgttccccccgtacggaacccccccttacccgttaccccaaccgtaaccggtcccgtcccctaacccgggg

SEQ ID NO: 43228 - DNA, 637 bp, Homo sapiens
  misc_feature: GYAE6OF01E47Z4.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacgggcccccaggcaaggggactgggagtgggtggctatttatactaagtttgagtaggaagtaattaaaaaattttaccgacagtactccggtagaagggccgtattcaccatctaccagacgacccttaccaaccatacgctagtactcctacaaatacgaactagtggtagacgtagttagaacgacgtacggactaactttattattagtagacgaagtagtttcggttggttacgagtctaatctaagtggtggagtagggtgccgtcgaccgaccggtggggaccgaaggggaaccacgtacggtccaccgttctcctacacgccctaccaccggaaccgggccctacgttcccggttcccttccccccgtcggtcccctacccccttcccacccgaagccgcccgtacccgg

SEQ ID NO: 43229 - DNA, 919 bp, Homo sapiens
  misc_feature: GYAE6OF01CUHW8.31.14.B03.1.454.CMB.1.raw
  modified_base (181)..(181): a, c, t, g, unknown or other
  misc_feature (181)..(181): n is a, c, g, or t
tcagcagtagacgtcacgaccggtgctcgatttagtgtgagtagtttgggctgagcttgggttttcctcgttgcttcttttaagaggtgtccagtgtcaggtgcacctggtggaatcgtggggaggcgtggccggccggtgggggtccctgagactctcctggtgccatcgtcgtgccgtntagtaattccattcctcgaacggctaacgtagtggacagtcgccgtaccggtcgggtcccgcccgaccgggacccccgaagggcgggtaaaacgggccgttagggggacgggttgggggttacgtacctttaaagttttaacgtaaccgttaaaggttttaggaaggttaaacgggtaaaagttaaaaaacgttttaaaaaaacgttttcccggacgtaaaccggtacgtaccgggtaacgggaaccgggtaccctaagttacccgacctaaattcccgaaccgtaacggtaaccctacccccttaaccgaaacctaacggtacccgtacgttacgttaccttaccttaacgaaaagtaaccgtaacgtaaggttacgggtaactacggttaaagtaacggaacgtaaccggacgttaaacttaagtttattacgtacgtagtaacgtaaagttcgtttggttaacgtacgtaacgtataacgttacgttaagttcgggtaagggtaggttaacgggcgtaaccgtaccgtaaccggtacccggggtacgggaaaccgtaacgggtaacccgttaccggtccgggttaaccctaccggttcccctagtacccggaccctccccgtaaacccggaaccggaacccggttcccttaacgggttcccccggttaccccccttaccgggcccctaacccgtacccccgtttacaccggtaaaccgccgtacccgtacccggg

SEQ ID NO: 43230 - DNA, 685 bp, Homo sapiens
  misc_feature: GYAE6OF01BJECD.31.14.B03.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (418)..(418): a, c, t, g, unknown or other
  misc_feature (418)..(418): n is a, c, g, or t
  modified_base (485)..(485): a, c, t, g, unknown or other
  misc_feature (485)..(485): n is a, c, g, or t
tcagcagtagacgtcacgaccggtgctcgatttagtgtgagtagtttggggctgagctgggtttcctcgttgctctttaagaggtgtccagtgtcacggtgcactggtggatctggggagcgtggtcgctgggggtcctgagactctcctgtgccatcgtctgcgtctgacttcgatccgtcaggcactagtggcatcgctacgtgggtccnccaggccccgaggcaaggctgggacggttgggngctaagtttaactaagtttgagtaggaagtaacttaaaaacgttttcggactaagtacctaccggtaggaacggggtcctaacttacctacgtactccgttaccgaagaaccggttacccctacccaaaccgtacgttaccggtactagtactcccttacaaagttcgaaacncgtaggtacgacgtagtacgaacgaccgacggtactaacgttattagtagtacggtacgaaaggttntttcggtacgttcgagctagttacaggttgtcgtaggagggtcgtcgtacgtacgtacggtcgggaccgtacggaacttcgtacggtcgtacctcgacctcgtaccgccttccgaaccgacggtaccctgttaccggtcccgtttaccccgaggtccccgtaccccgttaccgtaacccgagtccgcccgtaaccccggg

SEQ ID NO: 43231 - DNA, 819 bp, Homo sapiens
  misc_feature: GYAE6OF01BHTYR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcaccgtggtggaatcgtgggggagcgtggtccggccgtgggggtccctgagactctcctgtgccatgtctgcgtctgaattcatcctcgaggcactagtggacatcgctacgtcgggtcccaccgacggccccgaggaccgaagggacgtgggaggtgggtacgctatttagaacttaagttgaagtaggaagtaaacttaaaaagtttcgacgtaacgtaaccgtccggtaaggaacggggtacctaacgttccaacctaacttcctacccgaacgtacccgtacccctttaaccaaacctacgtaaccgtccgttacgttaacctactaacccgtaaagtacgtaaaccgtagtaggtacgtaaacgtaggtaaacgaaccgtacggaaccgtacttaaatttattacgttaggtacgaagtaaacggttagttccgggtttaggtaccgtaggtaactagtaacgtaagtagggtaacggttaggtaacggggtcggtaccgtaccggaaccgtaccgggtacggggtccgaaacgggtaccgtaaccggttcggtaaccccggaaccgtttcccgtacccgttaccgacccgtacccgtacccggaaacccggtaacccgggcccttaaccggttccccggttaccccccgttccccgaccggtacccccgtaaccctcccgtaaaccgaccggtaccgacccgttaacccggg

SEQ ID NO: 43232 - DNA, 676 bp, Homo sapiens
  misc_feature: GYAE6OF01EWFNB.31.14.B03.1.454.CMB.1.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (577)..(577): a, c, t, g, unknown or other
  misc_feature (577)..(577): n is a, c, g, or t
  modified_base (595)..(595): a, c, t, g, unknown or other
  misc_feature (595)..(595): n is a, c, g, or t
  modified_base (639)..(639): a, c, t, g, unknown or other
  misc_feature (639)..(639): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctgagactctcctgtgccatgtctgcgtctgaattcatcctcaggcactatggcatgcacgtgggtcccnccgacggccccaggcaagggctgggagtgggngctatttatactaatttgataggaagtaattaaaaaagttttcgactaagtactacggtaggaacgggccgtaattccacctacttacctcccgaaggtaaccgtaccccttaccaaacctactacggtcttagtactacctaccaaattacgaaactagtacgggtagaaccgtaggtttacggaaacgtaacgtaccgggtaacttaaacgtttaatttaacgtttaggtagtaacgtaaaaggttactttcgggtttagggttaccgagtactaagtactaagtgtggtagtagggtgctacgacgcggcgggcgaagggacncgtacgtcaccgtctccncgacgcctaccgaccgacggcccagttcccggtcccttccccgngacccctacccgtacctaccgaagtccgccgtaccgg

SEQ ID NO: 43233 - DNA, 909 bp, Homo sapiens
  misc_feature: GYAE6OF01BVGEC.31.14.B03.1.454.CMB.1.raw
  modified_base (221)..(221): a, c, t, g, unknown or other
  misc_feature (221)..(221): n is a, c, g, or t
  modified_base (824)..(824): a, c, t, g, unknown or other
  misc_feature (824)..(824): n is a, c, g, or t
tcagcagtagacgtcacgaccggtgctcgatttagtgtgagtagtttgggctgagctgggttttcctcgttgctacttttaagaggtgtccagtgtcaggtgcaccgtggtaggaatcgtgggggaggcgtcgggtcccggccggtggggggtccctgacgacttctcctgtcgcctatgtctgcgtctagtaacttcactcctacgaggactaacttagnggactagcgactaccggtcgggtacccgaccgaccggaccccgtaagggacggaaacgggtacgttagggaaggggttcgggtacgtattaaacgtttttaacgaaacgtttaaagttttaggaaagttaagggtaaaaacgttaaaaaagttttaaaaaaacgttttcggaaaccgaaacggttaacccgttacgggtaaacgggtaaacccggggttacctaaacttaacccgaaaccttaaccgttaccaaccgaacggtaacccttaaccccctttaaaccaaaaccgtaacgttaaccgtaccgtttaacgtaaacctttaccgaaaaccgttaaaaagacgtaaaacgtacgttaaggggtaaccgtaaaacgtaaaggttaaaccggaaacgaacccggtaacgtaaactttaaacgtttaaagtttaaggtacggtaagtaaaccggttaaaggtttcggttttaccgggtttaacgggtaacaagtaaaccttaacggttaataaaggttggtaagggtacggtacgggtcgtaccgaaccggacgtaccgggtacgggaaccgaacggaacctacgtcgtaccgtacctaccnctaccacgacccctacgaaccgcgtaccttacgggtcccttccacccccgagtaccccctacctaccgaccaagacgtccaccgg

SEQ ID NO: 43234 - DNA, 857 bp, Homo sapiens
  misc_feature: GYAE6OF01CDNIT.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcgaagggactgggaggtgggtggctaagtttataactaattttgataggaagtaattaaaaaattttcgacagactaccgtgaaggccgattcaccatctccagacgacccttccaaccatacgctgtactcctaccaaatcgaaacagttgggtagactagttaggaaacgaaccgacggactaaacgtttaatttagttaggtacgtaacggtaaaaggttacgttttacggggtttagggtttaccggaagtacctaagttaaccgtaaaggtttagggttagggtaaggtttaagggggttcggtacccgttacgggtaacccgtacccgggttaggggggaaccccggtaaagggggtaaacccgttaccgggttaccgggttaccccgtaacccccggtttaccgttaccccgttacccggaacccgttacccccgttacccccgaaaaccccgggtaaaccggggggtcccccccttaacgggtttacccccggggtttccccccttttaccccccccccgggttacccgggtaacccccccgtttaacccccccccgtttaccccgtaacccccggttaaaacggggtaccccgggtacccccgttaaacccccccggggg

SEQ ID NO: 43235 - DNA, 835 bp, Homo sapiens
  misc_feature: GYAE6OF01CD6A4.31.14.B03.1.454.CMB.1.raw
  modified_base (240)..(240): a, c, t, g, unknown or other
  misc_feature (240)..(240): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcggtgggggagcggtggtccggccggtggggggtccctgagcctctcctgtgccatgtcctgtcgtctagaatttcactcctcgacggcctactagtcggacagtcgcctacggtcggggtcccnccgaccgggcccccgaagggaccgaagggtcgtggggtaggtgggtacgcttaatttagtaactaagtttgaagtaggaaagttaaaattaaaaatttccgactaacggtacgtaccggtaggtacggtacctactaccacctactcctaccgaacgtaccctacccgttaaccaactacgtaccgtcttacgtacctacctaacctaaagtcaaacgtagtggtacagtacgtagaacgaccgacgtaacttaattagttagtggtaacgaacgttaacgtacgttttcgggtacggttaacgacgtactaactaacgtaaggtggtacgggttaagggtcgggtacggtaccgtacgggtaacccggtaccgggtaccggggtacggtaaaccggggtactacgggttccgtacccgtacccgttaccgtacccaccgtacccggtacccctaaaccccgggtacccgtaacccggggtccccttaacccgggttccccccgttcccccggttaccccccggtacccggtacccccttaacccccgtttaaccccgaaccccggaaaccgttaccccgtcccgggtaccccgg

SEQ ID NO: 43236 - DNA, 1200 bp, Homo sapiens
  misc_feature: GYAE6OF01AK3ZD.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcgtgggggtccctgagactctcctgtgccatgtctgcgtctagtaattcactcctcaggcactgtggctagtcggctacggtcgggtccgccgacggcccgaggcgaagggctgggtaggttgggcggtacttaattttacgtaacttaagtttggaacgtaggtaaagtaaaacgtttaaaaacgttttacgacgtacggtaccgttaccggtaggtaaacccggtaccggttaactttaccgaaccctaacgttcccgtaacccgtaaccggtaaaccccggttacccctttaacccgaaacccgttaaccgttaaccggttaccgtttaacgtttaaccgtaacccgtttaaaccgtaaaaccttaaccggtaaaaccgtaacgggtttaccggggtaaacggttaaccgggtaacggggtttaaaacggaaaacccggtaaacccggtaaaccgggttaaaccccttttaaaaaccggtttttaaaggtttttaacccggtttagggttaaaccggggtaaaccgggttttaaaccggtttaaacggtttttaccggggttttaaccggggtttaccggtaaaccggttaaccttaacgttaaaccggtttaaaggttacggggttaagggggtttaaaaccggtttacgggggggtttaaaccgttacccgggttaaacccccggttaacccgggggttacccgggggtttaaacccgggggacccccgggtttaaaaacggggggtaaccccggttaacccgggggtttacccggtttaaccccgtttaaaccccgggtttcccccggttaaacccggttccccccggtaaaccccgggtttaaccccgtaaaaccccccgggtaaacccccgggggttaaaacccccggggttaccccgtttacccccgggggttttaacccccccggttccccccgggttttttaccccccccgggaaaacccccgggtttcccccccccccgtttaaaaccccggttttaaccccccggtaaaccccggtttaaaccccgggcccccgggttttaaaccccccgggtt

SEQ ID NO: 43237 - DNA, 690 bp, Homo sapiens
  misc_feature: GYAE6OF01BKF0G.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccacgggcccccagggaccgaaggggactgggaggtggggtggctattttatactaatttgataggaagtaaattaaaaaattttcgactagaccgtccgtaggaacggggaccgtattccaccattcctaccgacggaccgtaccccttaccaaacctataccgctacgtactacctaccaaatcgaactagtggtagactagttagaaacgacgacggactaattattagttgtagaacgtaaagtcgtttcggttaggttacgagctagtacgtagttggtaggtaggtagggtcggactccggaaccgtccgggtaggggaccgtaagggtaacctccggttcgggtacctacccggtcctccctacgacccgtccctacccgaacggtaccggccctacgtcccggttccccttaccccgccggtacccctacccctacccgtaaccgacgccgtcccgtacccgg

SEQ ID NO: 43238 - DNA, 701 bp, Homo sapiens
  misc_feature: GYAE6OF01D9FV5.31.14.B03.1.454.CMB.1.raw
  modified_base (406)..(406): a, c, t, g, unknown or other
  misc_feature (406)..(406): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatcgcacgtcgggtcccgccgaacggcccccaggacaagggggaccttggggaggttggggtacggactaagtttttaacaacgttaagttttggaagttagggtaaagtaaaatttaaaaaaacgttttacgacaagtaccgtaccggtaggaaacgggcctaagttcaacctatcctacacgacgtaccctacaaccatacnctgtactacctacaaatacgaactagtggtagactagttacgaaacgacgaacggtactaaacgtttaatttacgttaggtacgacgtaaagttactttcggttaggtaccgaagntaacgtactagttagtaggtaggtagggtcgcgtacgacgaccggtgggacctaagggactcgtacggtaccacccgttcgaccctacgacctcccgtaccaccggaaccggtccctaagtcccggtcccttaccccgtcggacccctaccccgcctaaccgacgtccgccgtaaccgg

SEQ ID NO: 43239 - DNA, 924 bp, Homo sapiens
  misc_feature: GYAE6OF01BE0ZQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcaccgtggtggaatcgtgggggagcgtggtccggccgtgggggtccctgacgactctccgtgtgccatgtctgcgtctagaacttcagttccacgaggcctacttagcggctagtcgacgtacggtcgggtcccgacccgacggacccccgagggacggaacgggtcgtggggacgggtgggtcgtacttaagttttaataacgtaagtttagaagtaaggtaaaattaaaatttaaaaaacgtttcgacgtaacgtaccggttaccggaaggaaccgggtacctaacttacccgaacctacttacccgtaaccgtaacggtaaccctaacccccttaaccaaacctacgaccgtacgttacgtaacttaccctaaacctaaaagttacgaacctagggttacgaacgtaacgtaaaggttaacgaaaccgaaccgtaaacgtacttaaaacgttttagttacgtaggtaacgtaacggttaaagttcggtttacggttaggtacgagtaacttaactagtaaggttaggtgggtaaaggttccgggtaggtaccgtacccggttaaacggacccggggttaacggggaaccgaaacccggggttactacccggggtttaccgggtacccccttaacccggttacccgttaccccgccggttaaccccctaccccggttaaaaccccggaaaccccggggtaacccggttccccgttaaccccgttcccccggggttttacccccctccccggaacccggtacccccctacccccgtttaaccggacccggaacccggtacccgttccccgggtaaacccggg

SEQ ID NO: 43240 - DNA, 867 bp, Homo sapiens
  misc_feature: GYAE6OF01C4YNR.31.14.B03.1.454.CMB.1.raw
  modified_base (176)..(176): a, c, t, g, unknown or other
  misc_feature (176)..(176): n is a, c, g, or t
  modified_base (191)..(191): a, c, t, g, unknown or other
  misc_feature (191)..(191): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtntgaacttcatccgtnaggcactagtggctagtgcctacgtcggggtcccgaccgaccggcccccgagggaccgaaggggaccgtgggaggtggggtggtactaatttactaacgtaagtttgagtaggtaagtaaaaatttaaaaaagttttaccgacgtaagtaccggttaccggtaaggaaccggggtccgtaactttaccgaacccgtaacgtcccggtaacccggtaacccgtacccccttaaccgaaacctacgtaaccgtcttacgtaactacctaaccaaagttacgaaagtaagttgggtacgaacgttaggttaacggaaacggaccgtacggttaaaccttaaagttttagttttaagttagggtaacggtaaacggttaaacggttacggttttaccgggtttagggtttaaccggaatacccgttaagtacggttaagttgggtaacgggttaaggggttacgggtcggtaccgtaccgggaacccgttacccgggggtacggggaaccggtaaacgggtaaccgttaccgggttaccggtacccgtacccgtttcccgacccttaccggccgtaccccgtacccgaccggtaccggacccgttaccgttcccccggttacccttccccgacgtaccccttacccgtcccgaacccgtacgacgcccgttaccgcgggg

SEQ ID NO: 43241 - DNA, 1080 bp, Homo sapiens
  misc_feature: GYAE6OF01A1FSL.31.14.B03.1.454.CMB.1.raw
  modified_base (394)..(394): a, c, t, g, unknown or other
  misc_feature (394)..(394): n is a, c, g, or t
tcagcagtagacgtcacgaccggtgctcgatttagtgtgagtagtttgggctgagctgggttttcctcgttgctcttttaagaggtgtccagtgtcaggtcgcacctggtggaatcgtggggagcgtggtccggcgtgggggtccctgacgactctcctgtgcctatgtctgcgtctagtaattcatccctagaggtacacgttagtggctagtcgacctacggtcgggtcccaccgaaccggccccgaagggaccgaaaggggtacgtacgggtagggttgggtacgtactttagtttactaacgttaagtttggaagtagggtaaattaaaattttaaaaacgtttcgactaacgtaccgttaccggtaggaacggtccttataccaacctntccgtaccaacggtacccgtaaccctttaccaaacgtacgtaccgttacgttacgttacctaactaaacgtaaacgtacgaaccgttaaggttcgggtaactaacgttaggttaaacgaaacggtacccttaacggtaaccgtttaaagttttacgtttacggttaacggtaacggtaaacggtttaaacgttttaccggtttttaccggggtttacgggtaacccgtaagttaaacgtaaccgttaagttaaagggtttcgggttaaacggggtttaaagggttacccggggtttaccggtaaccccggtttacgggaaaccccccgggtttaccggggtttaaaccggggggaaacccccggtaaacggggttaaaccccgttacggggtttacccccgggttaaacgtttaccccccgttttaccggttaacccccggtacggttaaaccccccggtaaccccggtttaaaaccccccgggggaacccgttaaccccccgggggttaacccctttttacccccggggtttaaccccccggggtttttccccccccccgttaacccccgggtaaacccgggttaaccccccccccccttttaacccgggttaaaccccccggttaaaaccccggggaaacgttttcccccccgggtaacccccggggtttaaaacccccggggg

SEQ ID NO: 43242 - DNA, 845 bp, Homo sapiens
  misc_feature: GYAE6OF01EHJ02.31.14.B03.1.454.CMB.1.raw
  modified_base (216)..(216): a, c, t, g, unknown or other
  misc_feature (216)..(216): n is a, c, g, or t
  modified_base (290)..(290): a, c, t, g, unknown or other
  misc_feature (290)..(290): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtgggggtccctgagactctcctgtcgccatgtctggcgtctagtaacttcatcctgacggctaactgtggaccatcgacncggttcggcccgaccgaccggccccgaaggacgtaaagggtcgtagggtaggttgggtcgtacttaagttttanaacgttaagtttgaagttaggtaaaattaaaacgtttaaaaaacgtttcgacgtaacgtaccgtacggttaaggaaccgggtacctaacttccgaaccttacgttacccgtaccgaacgttaccccgtaaccccttacccaaacgtactaccggttacgttacgttaaccttaacccaacgtaaaacgtacggtaaaccgtagtacggggtacaacgttaggttaacgaaccgacgtaaccggtactttaaactttagttacggtacgtaacggtaaggtaaacgtttcggttttcgggtacggttaactagaacgttaactacggtaattcgggggtagtaacgggtggtaccgcgtacggaccgtacgggtccggggtaaacgaaggtacccgtacgttacggttaccctaccccggttacttacccgaaccgttacccggccccttaacccggaacgtaacccccggtccttaccgggtttcccctccccggttaccccgtacgcccccttacccgtacccgaaagttaccggaccgcccggttacccgggg

SEQ ID NO: 43243 - DNA, 709 bp, Homo sapiens
  misc_feature: GYAE6OF01CSXCB.31.14.B03.1.454.CMB.1.raw
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcacttagtggcatcgcacgtcgggtcccgccacggccccgaggaccgaagggctgggaggtgggngctatttatactatttgagtaggaataaattaaaaatttcgacagtactccggtaggacggccgattccacctatcctccaagtaccgtaccccttaccaacctataccgctacgtactaccctaactaaactagtaaacagttagggacgtaacgtaggttaacggaaacgaaccgacgggttaacttaaactttaatttagttgtaggaacgttaaagttgtttccgggttaggtacgagtactaatactaaggtggtagggtaggtagggtccggtcgtaccgacgtcccgggtacggggaccaagggtactacggtccggtacctcccgttactccgtccgaccgtaccccgtacccgaccggaccggtacccgttaccgttcccggttccccttcccccgtacggccccctaccccgtaccaccgaacgcccgtacccgtacccggg

SEQ ID NO: 43244 - DNA, 638 bp, Homo sapiens
  misc_feature: GYAE6OF01ASR79.31.14.B03.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (349)..(349): a, c, t, g, unknown or other
  misc_feature (349)..(349): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtccnccaggccccaggcaagggactgggagtgggnggctatttatactaatttgatggaagtaattaaaaaatttcgacagactcggtaggaacgggccattcacctatctccgagacgaccccttaccaaccagtacnctagtactcctacaaatgaaacagtggtagactagttacgaagacgacggtactaaactttattagtgtagacggtaagtactttcgggtttaggttacgagtctaagttactaagttggtagggtagttaggggtcgccgtacggacgtaccgggtcgggaccgaacgggactacgtcggtacctaccgtctcctcgaccgtccaccgaccgtaccggcctaccggttccggttccccttccccgacggaccctaccccgttaccgaccgaacgtcgccgtacccggg

SEQ ID NO: 43245 - DNA, 879 bp, Homo sapiens
  misc_feature: GYAE6OF01AIRJJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggcctggggggtccctggagactctcctgtgccatgtctgcgtctgaattcatcctcaggcactatggcatgcacgtcgggtcccgccgacggcccccgaggacgaagggacgtgggaggtggggtcggacttaagtttactaactaatttggagtaggaaagtaaatttaaaaaacgttttcgacaacggtaccgtaccggtaggaacggggacctattaccaaccgtactcctaccgaacgtaccgtaccccttaccaacctacgtaccgtactacgttactacctaaccaaagtacgaaactagtacggtacaacgtaaggttacgaaacgtaaccgtaaccggtacttaaaacgtttaagtttagttacggtaagtaaccggtaaaaggtttcgttttccggggtttaacgggttaccgaacgtaactacgttaaccggtaaaggtgggttaacgggtaagggttaccgggggtacgtacccgtacccgggaaccgttacccgggggtacggggtaacccgaaaggggtaacccgtaccgggttcgggttaacccctaccggttccccgttacccgtacgtaacccgggcccccttaaaccccggaacccggtaaacccgggtcccccttaaccggtttccccgggttaccccccgtttccccccggaacccggttaccccctaaccccccgttaccccggtaaccaaaccggtcccccggtcccgttaaacccccggggg

SEQ ID NO: 43246 - DNA, 650 bp, Homo sapiens
  misc_feature: GYAE6OF01E0D2J.31.14.B03.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (578)..(578): a, c, t, g, unknown or other
  misc_feature (578)..(578): n is a, c, g, or t
tcagcagtagacgtcacgaccggtgctcgattttagtgtgagtagtttgggctgagctgggttttcctcgttgcttcttttaagaggtgtccagtgtcaggtgcacctggtggaatcgtgggggagcgtgggtccggccgtggggggtccctgagctctcctgtcgccatgtctgcgtctagaattcatcctnaggcactatggcatgcacgtcgggtccnccacggccccgaggacgaagggctgggaggtgggtgactagtttanactagttgataggaataattaaaaattttacgactagactcgtaggaacgggcctacttcacctacttccgtaccacggtaccgtaccccttacccgaacctacgtaccggtctcgtactcctaaccaagtacgaactagtggtacacgtaagttacgaagactacggtactaacgttattacgttaggtagtaacgtaagttacgtttcggttcggttacgagtactagtactaaggtcgtaggagtgggtcgacgtacgacgaccggtgggacgagggaccgtagtcgacctcgtccgctcgacgtccnccgaaccgtacggccctacgtccggttcccttcccgccgtaccctacccctccaccgactccgcgtacccgg

SEQ ID NO: 43247 - DNA, 912 bp, Homo sapiens
  misc_feature: GYAE6OF01BLO7M.31.14.B03.1.454.CMB.1.raw
  modified_base (194)..(194): a, c, t, g, unknown or other
  misc_feature (194)..(194): n is a, c, g, or t
tcagcagtagacgtcacgaccggtgctcgatttagtgtgagtagtttgggctgagctgggttttcctcgttgcttcttttaagaggtgtccagtgtcaggtgccacgtggtaggaatcggtgggggagcggtggtccggccgtggggggtcctgagctctctgtgccatgtctgtcgtctgaacttcacttccncgaggaccacgttagtcggctacgtcgaccgtaccgggttcggggtccccgaccgaccggggaccccgaggggacggtaaacgggggtcgtaggggacggggttggggtacgtactttaaagttttactaaagttaagttttaggaaggttaagggtaaaactttaaaaaagttttaaaaaaccgttttccggaaccgtaaggtaccccggttacggtaacggggaaccgggtaccttaactaccccggaaccttccgtaacccgtaccgaacccggtaacccgttaaccccctaacccgtaaaaccgtacgttaacccgccgtttaacgttaaacctacccgtaaaaccgttaaaagcgaaaccgttaggttacgggtacgtaaacggttaacggtaaacggaaacggtaccggtaaaccgttaacctttaaagttttacgttaaggtcggtaaagtaccgttaaagtttcggtttacggtaggttaccgagttaactagtaacgttaggtagggtagggtaggtaccgggttcgaaccggtacgtacgggtacccgggtacgggaacgaacggttaccacgggttcccggtaccacccggttccacccgttacgacccggtacccgtaccggacccgaccgggtccctacccgggttccctcccccggttccgacccgtaaccctccccacgtaccgacggcccgtcccgggtcgg

SEQ ID NO: 43248 - DNA, 1004 bp, Homo sapiens
  misc_feature: GYAE6OF01A5O8I.31.14.B03.1.454.CMB.1.raw
  modified_base (198)..(198): a, c, t, g, unknown or other
  misc_feature (198)..(198): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctcaggcactanggcatcgcacgtcgggtcccgccgacgggcccccaggcgaagggacgtgggaggtgggtggctatttatactaatttgatggtaagtaattaaaaaattttacgactacgacgtccggtagggaaacgggtcccgtaactttaccaaccctacgttacctacccgaacggtaacccggttaaccccctttaaccccaaaacccctaacgttaaccgtaccgttacggttaaccttaccttaacctaaaacgttacgaaaaccgtagtttacgggtacggtaaccgtaaggttaacggaaacgtaaccgaaaccgggtacttaaaacgttttatttaacgtttaggtacggtaacggttaaaaggttacgttttacgggtttacgggtttacggaacgtacttaacgttaccgttaaaggttcgggttaaggggtaacggtttacgggggttacggggtacccggtttaacccgggaacccggttaacccggggttacggggggaaccccggggaaacgggggttaaaccccgaccgggtttaccgggttaccccgttaacccccggggtttcccttaccccccgttaaccggtaacccccggtacccccctttaaaccccgggaaaaccccccgggttaaccggggacccccccgttaacccggtttacccccgggggttttccccccgtttaaccccccccccggggttccccggttaccccccgttaaacccccccccgtttaccccggtaaaccccccggtaaaccgggggttaccccgaaccccccgggttaaccccccggg

SEQ ID NO: 43249 - DNA, 742 bp, Homo sapiens
  misc_feature: GYAE6OF01A3SQ5.31.14.B03.1.454.CMB.1.raw
  modified_base (191)..(191): a, c, t, g, unknown or other
  misc_feature (191)..(191): n is a, c, g, or t
  modified_base (467)..(467): a, c, t, g, unknown or other
  misc_feature (467)..(467): n is a, c, g, or t
  modified_base (650)..(650): a, c, t, g, unknown or other
  misc_feature (650)..(650): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctgagactctcctgtgccatgtctgcgtctgaattcatcctnaggcactatggcatgctacgtcgggtcccgccgacggcccccgaagggaccgtaaagggacttggggaggtgggggtcggtactaattttaataacgtaaagttttgaagtagggaagtaaatttaaaaaaagttttccgacaagtacgttccggtaagggaacgggtacccgtaattaccgaacctacttacctaccgaacgaccgtaaccccttaccaaacctataaccgtccgttaagttacctactaccaaagtacgaaactagtacggtanacgtagttaagaacgacgacggtactaaattacgttagtagttacgaacgtaaagttacgtttggttagggttaacgagtactaagttacaagtttggtagggtaagttacggggtgtaccgtccgtaacgtacgggtacggggccgaagggtaacctacgggtccgtacctacgtcctaccncgtaccgcctacccgaacgaccggtaccgtacgtcccggttccctcccgtaccggacccctacctaccgaccgtacgaccgtccgtacccgg

SEQ ID NO: 43250 - DNA, 772 bp, Homo sapiens
  misc_feature: GYAE6OF01ASWX2.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctggtttcctcgttgctcttttaagaggtgtccagtgtcaggtgcacctggtggaatctgggggagcgtggtccggcctggggggtccctgagactctcctgtgcccatgtctgcgtctagaattcatcctcaggcactatggcattgcacgtcgggtcccnccgaacggccccaagggcgaaacgggctgggaggttgggtgcctagtttacaacgtaatttgatggaaagtaaattaaaaaacgttttcgactaagtacctaccggtaggaaacggtccgaattccgaactactccaccgagaccgtacccttaccgaaccagttaaccgtcttaagtactacctaaccaaagttacgaaactacgttcggtaacgacctaaggttacgaaacggtacccgtaaccggtaactaaaccgttttaagttaacgttccggttaagtaacggtaaaacgttacgtttaccgggtttaggtaaccggtacgtaaccgtacgttaaacgtaagtttagggtaccggtaagttagggtacggtacctaccggtaacgacccgggtagggccgtaaacgggaacgtcgtcggttaacccacgttaccaccgtactaccgcccgtaaccgacccgtaggaccccgtaacgtcccggttacccttacccccggtcggaacccctccccgttaaccctaccgacctaaacggtccctaaacccgg

SEQ ID NO: 43251 - DNA, 951 bp, Homo sapiens
  misc_feature: GYAE6OF01AP69S.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtggggaggcgtggtccggcgtgggggtccctgagactctctgtgcatgtctgcgtctgtaattcacttccctcgacggcctacgttagtcggcagtcgaccgtacggttccggggtcccgacccgaccggccccgaagggtaccggaaacggggacgtggggacgggttcggggtaggtaccgttaatttttaacgtaacgttaagttttaggaagttaaggggtaaaagttaaaaacgttttaaaaaaaccggttttaccggaccgtaacggtacccgttaaccggggttaacgggaaaccggggtccccgttaacttacccaaccgtacttacccgtacccgaacggttaacccgtaccccctttaacccgaaacgttaaccgtaccgttacgttaacgttaccttaaccctaacgtaaacgttacgaaacgttagttacggggtacaaggtttaacggttaaacgaaccggtaacccgtaacggtaaaccttaagtttaacgtttaggtttacggaacgttaacggtaaagtttccggttttacggttcgggtacggtacgtacttaacgtaacgttaaggttacgggtaagggttcgggttaacgggtcgtaaccgtaccgtaaccgggtaccgggtaccggggaaccgtaacgggtaccgtacggtaccggtaccctaccggttacccctaccgtccgtacccggttacccgaccccggtaacccggtaacccgggtccctacccggtttaccccggtccccccgtttccccggaccgtaccccctcccgtttaacccgaccgtaccggtacccgtccccgtacccggg

SEQ ID NO: 43252 - DNA, 698 bp, Homo sapiens
  misc_feature: GYAE6OF01A2SAP.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggctgggagtgggtgctatttanactatttgatggagaataaaaatttcgacagactcgtgaaggccgattcaccatcncagacgacccttaccaaccatacgctgtactcctaccaaagtcgaactagtggtagaacgtagttacggaacgactacgggactaaacgtttattattggtagacgtaaagtacgtttcggttacggttacggatacgtaatcgtaaatggtaacgggtagttacggggtcggtctacggaacctaccgggtacggggacccgaacggggtaaacctaccggttacgggttaccctaaccccggttctaccccgtacctacggtaccccgttacccgaaccggtaaaccggggccccttaaggttccccgggttccctttcccccccggaggttaccccctacccccgttacccgtaacccggtaaccggacgtccgttaacccccggg

SEQ ID NO: 43253 - DNA, 706 bp, Homo sapiens
  misc_feature: GYAE6OF01ENV3S.31.14.B03.1.454.CMB.1.raw
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccnccacggccccaggcaagggactggaggtgggtgctatttanactattgataggaagtaattaaaaatttcgacagactcgtagacggcctatcaccatctccagacgacccttaccaacctactaccgcttagtactacctaccaaatacgaactagtcgggtagacgtaggttagaaacgtacaacggtactaaactttaatttagttaggtacgaacgtaaagtacgtttcggtaggttacgagtacctaagtactaaagtgggtaggtaacgttacggggacgtccttaccggaaccgtccgggtacggggacccgaacggggtaacctacggttacgggtacctacccggttcctaccctacgaccgtacccgtaccccgaacggaaccgggtccccctaaggttccccggttcccgttccccccgtagggacccccttaccccgttaccccgtaaccggtaaccgaccgtccccgtaacccggg

SEQ ID NO: 43254 - DNA, 934 bp, Homo sapiens
  misc_feature: GYAE6OF01AGETR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacggccccaggcaaggggactgggaggtgggtgactagtttatactaatttgagtaggaagtaaattaaaaaatttcgactagacctaccggtaggaacgggccgtattaccaaccgtacttacccgtaccgaacggtaaccgtaaccccctttaacccgaaaccctaacgttaacccggtacgtttacgttaaccttacccttaaaaccccgtaaaaagttaacggtaaaaccgtaacgtttagggggtaacggtaaaacgttaacgggtttaacggaaaaccggtaaccggtaaacccgggtaaaccctttaaaacgttttaagtttaaacgtttacgggttaagggaaaccggttaaaaggttacggtttttaccggggttttaagggtttaccgggaacgttaaccgttaacgttaacgtaaaggttggggttaagggtaaacggggtttacgggggtacggtaccccgttaaccgggaacccggtacccggggtacggggggtaacccgaaacggggtaaacccgtaccggttacgggttaacccctacccggttacccttacccgtccgtaacccggtccccgtaaaccccgaacccgggtaaccccgggtacccctaacgggttacccccggttcccccttacccccccggtggtaacccccctacccccgttacccgtaacccggaacgtcccgtaccccgtacccggg

SEQ ID NO: 43255 - DNA, 994 bp, Homo sapiens
  misc_feature: GYAE6OF01CC4CX.31.14.B03.1.454.CMB.1.raw
tcagcagtagacgtcacgaccggtgctcgatttagtgtgagtagtttgggcgtgagctgggtttcctcgttgctcttttaagaggtgtccagtgtcaggtcgcacctggtggaatcgtggggagcgtggtccggcgtgggggtcctgagcctctccgtgtgccatgtctgcgtctagaacttccacttccgtcgaggcctaacttagtggacctagtcgaccgtacggtcggggtcccgaccgaaccgggcccccgaaggggaccgtaacgggggtaccgtgggagggttgggtcggtacctaattttaacgtaacgtaagtttaggtaagttaaggtaaagtaaaaacttttaaaaaaacgtttaccggaaccgtaacgtaaccggttaaccgggtagggtaaaccgggtacccgtaacgtttaccccgaaccgtaaccgttacccgtaacccggaaacggtaaccccggttaaccccttaaccgaaaccctacgttaaccggtcgttacgttaaccgttaacctaaaccgtaaacggtaacgtaaaccgtaggttacggggttaacgaacgttaacggttaacggaaaaccggtaccggtaaaccgttaaccgttaaacgttttaatttacggttacggtaaccggtaaacggtaaaggtttcggtttaccggggtttaggtaacgtaacggtactaaagttaccggaaagtttaggggtacggtaaacggtacggggtccgtaccgtaaccggaaccggttaccggggaaccggggaaccgtaaaacgggtaaccgttccggtaccggtacccgtaacccgtttccggaccctaaccggaacccgtacccccggtaccccgaaccgggttaaaccccgggtcccgttaccggttaccccccgggttcccccttaaccccggtaccggaacccccgtacccccgtttaacccaacccgggtaacggaaccccgtcccgggttaaacccgggg

SEQ ID NO: 43256 - DNA, 608 bp, Homo sapiens
  misc_feature: GYAE6OF01AJW01.31.14.B03.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactggggtcccnccagggcccccaggcaagggctgggagtgggtggctatttatacaatttgatggaagaattaaaaaattttcgacagactccgtgaagggccgattccaccatcnccagacgacccttaccaaccactacgctgtactcctacctaaatcgaacagtggtacgactaagttgaaacgacgacggtactaaactttattattgtagtacgtaaagtntttcggttggttcgagctatacaagtgtaggagtagggtgtctcgacaccgtgggccaagggacacgtcggtaccaccgttctccgtcgactcccgtacccaccgtaccggccctaggttcccggttcccttcccccgtgcccctaccccgtccctaccgacgtccgcctacccgg

SEQ ID NO: 43257 - DNA, 905 bp, Homo sapiens
  misc_feature: GYAE6OF01C85ER.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgacgactctcctgtcgccatcgtctgcgtctgaattcactcctcgacggctaacttagtcggctaagtcgaccgtacggtccggggttcccgacccgaacggggacccccgagggaaccggtaacggggacgtaggggtagggttgggggtacggacttaagttttaactaaccgtttaagttttaggaacgttaaggggtaaaagttaaaacgtttaaaaaaaaccgttttacgaaccgtaacggtaaccggtaccggttacgggaaaccggggttacctaacgtttaaccaaccgtaaccttaccgtaccgaacgtaaccggttaaccccttaacccaaccctaacgtaccgtacgtttacgtaacttaccgtaaacctaaagttaacgtaaaccgtacgtttaagggtacgaaacgttaacggttaaggaaaccggtaaccgtaaccgttaacttaaacgttttaagtttaagttagggttacgaacgggtaagttacggttttacgggttacgggttaacgacggttactacgaagttaggtagtagggtagtaggggtctacgtaccggacggtaccggtacgggaaccgtaacgggtccgtaaccgtcggaacccgtacgttcccgtaccaccgtaccggccctaacccggaccggtaacccgaaccggttcccttacccggtcccccttacccgggtaccccgtcctaaccccccgtacgaacccgaacgtcccggtcccgtaccggg

SEQ ID NO: 43258 - DNA, 902 bp, Homo sapiens
  misc_feature: GYAE6OF01EN7D9.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtggggggtccctgagactctcctgtgcctatgtctgcgttctagaattcatccctgaggctaactagtggacaagtgccgacggttcggggtccccgcccgaaccgggcccccgaaggggacgaaacgggggtaccttagggggaggttcggggggtggtaccttaaagtttttaaaccgtaacttaaagtttttaggaagttaggggaaaagttaaaaatttaaaaaaaacgtttttaccgaccgtaaacggtaccttacccggttaggggaaacggggtaccccgtaatttacccaaccgtacgttacccgtacccgaaggtaacctaacccccgtttacccaaacctaacgttaaccggtccttaagttacctaccttaacccgtaaaattacggaaaactagtacgggtaacgtaaacgtaaggttaaacggaacgtaacgaacggtaacttaaactttacgtttaagttagtacgaaacgtaaagttagtttacggttaggttacagactaactacgtaatagggtaggtaggttaggggtagtaccgtacgaaccggtaccggtacggggtaccgaaaccggggaactacgggttaccggttacccgtaacccgttacgttaccccttacggaaccgtccctaaccccggaacccgtaacccgggaccccttaacggttccccggttacccccgtttcccccgagggtacccccctaccccgtaccctaacccggtaaacgaacccggccgtaacccggg

SEQ ID NO: 43259 - DNA, 866 bp, Homo sapiens
  misc_feature: GYAE6OF01C8BDV.31.14.B03.1.454.CMB.1.raw
  modified_base (810)..(810): a, c, t, g, unknown or other
  misc_feature (810)..(810): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtcccggccgtggggggtccctgagacctctcctggtgccagtgtctgcgtctagtaattcactcctacaggctactagtggctatcgccacggtcgggtccgccgaccggccccaagggcgaaagggtcgtgggtagggtgggtggacttaagtttataacgtaagttttgagtaaggtaagtaaaactttaaaaaaagttttccgacgtaagtaaccgtaccggtaggaacgggtacccgtaatttccaacctagtcctaccgaacgaaccgtaccccttaccaacctaacgtccggtatacgttaactaccgtaacctaaaagtcgtaaacgtagttacgggtacgtaacgtaggttaagaaacgtaaccgaacggttaactaaacgttttatttaacttacggttaggtaacgttaaaaggttcggttttacgggtttacggttaccgtaaggtactaacgttaacgtaagttacggggtacgggttaaagggtagggttaccgggtacgtttacccggaaccggttaccgggtaccgggggaacccgtaaacggggggtaaccaacggggtttcccggtaccgttacccgggttccctacccgttacgaaccggtaccccctaccgaaccccgggtaccggtaccccgtagggtttcccccgttccctttacccccggnggttaccccccttacccgtccccgtaaccggaaccgtccggttcccgaaacccggg

SEQ ID NO: 43260 - DNA, 716 bp, Homo sapiens
  misc_feature: GYAE6OF01DSXD9.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcctggggggtccctgagactctcctgtgccatgtctgcgtctgaattcatcctcaggctactatggcatgcacgtcgggtccgcacggccccaggacaagggactgggagtgggtgctatttatactaatttgatggaagtaaattaaaaaacgtttcgactaacgtaccgtccggtaggaacgggccgtattaccaccacttccgtaccacgaacccgtaccccttaccaacctacgtaccgtctagtactacctaaccgaaatacgaaactagtacggtacgacgtaagttacggaaacgacctacggtactaaactttagttagttacggtagaacgtaaagttcgtttacgggttggttacgacgactatactaagtggtaggtaggtagggtcgtacgtacgacgtaccgggtacggggaaccgaagggtaacctcggtcggtaccgtacccgttactcccgactaacccgtccgaacccgaaccggtaacccggtcccgtaaccgttcccgggttccccttcccccggtagtaccccctcccgtacccctacgaaccgtcgtacccgtaccccggg

SEQ ID NO: 43261 - DNA, 525 bp, Homo sapiens
  misc_feature: GYAE6OF01ALOYT.31.14.B03.1.454.CMB.1.raw
  modified_base (251)..(251): a, c, t, g, unknown or other
  misc_feature (251)..(251): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (465)..(466): a, c, t, g, unknown or other
  misc_feature (465)..(466): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggcccccaggcaagggctggagtgggtgcatttanacaatttgatggagataaaaaattttacgcagactccgtgaagggccattcaccatctccagagacccttcaaccatacgctgatctccaaatgaacatggtgacagttgaagacacggcaacttattattgtgacgtaagatttcgttgggtcgtagcagtcaagtgtagatagggtgctcgacacgtgggccagggacnctgtcacgtcncnngcctccacagggcccagtccgtcttcccccgtgcccaccctcctaccaagcgcctaccg

SEQ ID NO: 43262 - DNA, 833 bp, Homo sapiens
  misc_feature: GYAE6OF01A2L8W.31.14.B03.1.454.CMB.1.raw
  modified_base (529)..(529): a, c, t, g, unknown or other
  misc_feature (529)..(529): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtgccatgtctgcgtctgaattcatcctcgaggcactagtggcatgcacgtcgggtccgccacggccccgaggccgaagggactgggaggtgggtgactaatttacaactaagtttgagtaggtaaagtaaatttaaaaaagtttcgacgtaacgtaccgtaccggtaggaacggggtcctaagtttaccaccgtacttcccgtaccgtaacggtaacccgtaacccccgtttaccaaaaccccgtagttaacccggactttaccgttaacgttacccttaacccgaaaagttacgaaaccgtaaggttcgggtacaaccgttaaggttaacggaaacggtacccgtaaaccggactttaaaaccgtttntttaacgtttagggtaacgtaacggtaaacgtttacggtttacgggttacggttaacggacgtactaacgtacgtaacgttgggtagggtaaggttcgggtacggtaccgtaccggtaaccggtaccgggtacggggaaccgtaaacgggtaaccgtacgttccggtacccgttacccgttcgtacccgtcgaccgtaccccgtaacccggaacccggtaaccggtcccctacggttccccggttcccgttacccccgcggtacccctaccccgtccgaaaccgcgtaccggccgttacccggg

SEQ ID NO: 43263 - DNA, 770 bp, Homo sapiens
  misc_feature: GYAE6OF01BAUGK.31.14.B03.1.454.CMB.1.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtcccggccgtggggggtccctgagactctcctgtgccatgtctgcgtctgaattcatcctnaggcactagtggcagtgcacgtcgggtcccncgacggccccgaggcaagggactgggagtgggtgctatttanaactattgagtaggaagtaaattaaaaatttcgactagtacgtccggtaggaacgggtcctattaccaccgtacttccgtaccacggtaccgtaccccttaccaaccgtataccgcttacgtaactaccgtaaccaaagtcgaaactgtaggtacgaagtagtacgaacgtaaccgacggaactttaacttaagttagttaggtacgtaacgtaaaagttcgttacggttagggtacgaagtcgtaagtacgtaaggttcggtagggttacggtacgggtcgtacccgtaacggtaccgaccgggtaggggacccaacggggtaacctaccgggttaccggtacccgtaacccgtccctaccgtacccgaccgggtccctaccccgaaaccggtaccgggtcccttaacccgggttcccggtttcccccgttcccccgggttacgtaaccccccgtaccccgttacccgaacccgtaaaccggttacccggcccgttaaccccgggg

SEQ ID NO: 43264 - DNA, 630 bp, Homo sapiens
  misc_feature: GYAE6OF01APVTR.31.14.B03.1.454.CMB.1.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (617)..(617): a, c, t, g, unknown or other
  misc_feature (617)..(617): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgcacgtcggggtccnccgacggcccccaggcgaagggctgggagtgggtgctatttanactatttgatggataattaaaaatttcgacagactccgtaggaggccgattcacatcctcagacgtaccccttacaaccagtaccgcttagtactcctacaaatcgaaacagtggtacacgagttagaacgacgacggactaactttatagttgtagacgtaagtcgtttcggttggtcagtactatacaagtgtaggtacgtagggtcgcctacggacctaccggtggggaccaagggaacctcggtacggtccgaaccgttcctacccgtcgaccgtccctacccgaacggaacccggtccctaacgttcccggtccccttcccccgtgaccccctacccgtcccacgaacgcncccgtaacccggg

SEQ ID NO: 43265 - DNA, 928 bp, Homo sapiens
  misc_feature: GYAE6OF01ETSL0.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcgtgggggtccctgagactctcctgtgccatgtctgcgtctagtaattcatcctcgaggtcctacgttagtcggctagtcggccgtacggtcggggtcccgccgaccggtaccccgagggtacgaacgggtcgtgggtaggttggggtcgtacttagttttacgtaacgttaagtttggaacgttagggtaaagttaaaacgtttaaaaaaacggttttaccggtaacggtaaccgttaccgggtaagggtaaaccggggtcccgttaactttacccgaacctacgttcccgtacccggaacggtaacccggtaaccccctttacccgaaacctaacgttaccgtcgttacggttaaccttcccgtaaaccgtaaacgtacggtaaaccgtaggttacgggttaacgtaaccggttaggtacggaaacgtaccggtaaccgtactttaaacgttttagtttacggtttaggtaacggtaaacgttaaagggttccgttttacgggtttacgggtaccgtaacgtataacgttaacggtaaggtttggggtaacggtagggttacggggtacgtcccgttaccgggaaccggtaccgggccgggtaacgaacggggttaacctacggttccggttaccgtacccggttctacccggtaccacccgtaccgtaaccccgaacgggtacccgggtaccccgttaccggttcccccgttccccgtcccccgcgggttacccccctaaccccgttaccgtaaccggaacccggtcccgtacccgtccggttaaccggggg

SEQ ID NO: 43266 - DNA, 791 bp, Homo sapiens
  misc_feature: GYAE6OF01BYRCY.31.14.B03.1.454.CMB.1.raw
tcagcagtagacgtcacgaccggtgctcgatttagtgtgagtagtttgggctgagctgggttttcctcgttgctctttttaagaggtgtccagtgtcaggtgcacctggtggaatctgggggaggcgtggtccggcctggggggtccctgagactctcctgtgccatgtctgcgtctgaattcatcctcaggcactatggcatgccacgtcgggtcccgccacggcccccaggacgaagggactgggagtgggtggctagttttatactaagtttgataggaagtaaattaaaaaaacttttcgacgtaacgtaaccttaccggtaggtaaacggggcccgtaactttaccaacccgtattcctaccgaagaaccgtaccccttacccgaaacccaactaccgcctagtactccgtaacccaaatacgaactagtggtagacgtagttagaacgacacgtactaacttattatagtagacgtaaagttcgtttcgttaggttcgagtactagacgtaagttggtagggtacgtagggcgtactacggaaccgtaccgggtacggggaccgtaacgggtaacctaccgggtacggttaacccgtacccggttacccgtcccgttacccgaacccggttacccctaccccggaaccccgggtaaacccgggtccccccgttaacggtttaccccccggggttcccccttcccccccgggttacggaacccccccttacccccttcccggaaacccccgtaaaccgggtaccccgtacccgttaacccccgggg

SEQ ID NO: 43267 - DNA, 910 bp, Homo sapiens
  misc_feature: GYAE6OF01D5846.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggctgggggtccctgagactctcctgtgccatgtctgcgtctgaattcatcctcagcactatggcatgctacgtgggtcccncacggcccaggcgaagggactggaggtgggtgactatttagactaaagtttcgaagtaggaagtaaaatttaaaaaacgtttcgactaaggtaaccgtccggttaagggaacgggtacccgttaacgtttacccaaccttaactacccttaaccgaacggtaacccgtaacccccttacccgtaaaccgtaagttacccgtaaccttagttaaaccttaccgtaacccgttaaaagtccgtaaaaccgtagttcgggtaacgtaaccgttaggttaaacggaacgaccgtaaccggtaaacttaaacgtttacgtttaagttcggtaacggtaaacgttaaaacggtttacgtttaccgggtttaacggttaccgtaaaccggtacttaaacggttaacgtaaacggttttcgggaacggggttaacgggtttaacggggtccgtaacccggttacccgggaaacccgttacccgggttacggggggaaacctaaacgggggtaaccctacgggtttacgggtacccccttaaacccgggttcctaccggtaacctacccgtacccgttaaacccccgacgggtaaacccgggtcccttaacggtttccccggttcccgttaccccccggtagtacccccggtaacccccctttacggaaccggaaaccggtaaccgtccccggttaaaccccggg

SEQ ID NO: 43268 - DNA, 684 bp, Homo sapiens
  misc_feature: GYAE6OF01BFUZ6.31.14.B03.1.454.CMB.1.raw
  modified_base (218)..(218): a, c, t, g, unknown or other
  misc_feature (218)..(218): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagacctctcctgtgccatgtctgcgtctgaattcatcctcgaggcactatggcatgcacgtgggtccnccgacggccccagggaccgaagggactgggacggtggggtcgactaattttacactaatttgagttggaagtaattaaaaaattttcgacaggactcgtaggaacggcgattcaccatctcagactaccctaccaacactacgctgtatcacaatacaacatgnaacgnttagaancgacgactaacgttattagtagtgactaaagtatttcggttaggttacgagtactatactaagtgggttacggtaggttaacgggtggtccgtacggaacccgtaaccgggttccggggaccggaacgggtaacgtaaccggtacgggttaccctacccgggttacctccctaccgtaccgtcccctaccgtaaaccccggaaccggtcccccgtaacgttcccggttccccgttaccccccgtcgtaccccgtcccctacccgtcccaaacggcgacccctaacccggg

SEQ ID NO: 43269 - DNA, 717 bp, Homo sapiens
  misc_feature: GYAE6OF01ASMCF.31.14.B03.1.454.CMB.1.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
tcagcagtagacgtcacgaccggtgctcgatttagtgtgagtagtttgggctgagctggggttttcctacgttgctcttttaagaggtgtccagtgtcaggtgcacctggtcggaatctgggggagcgtggtccggcctggggggtccctgagctctctgtgccatgtctgcgtctgaattcatcctcaggcactagtggcatgctacgtgggtccnccacggccccaggcaaggggtactgggacgtgggtggctatttanactatttgactgggactaattaaaaatttcgnanactcgtagaaggccgtatccaccatctacgacgacgtaccccttaccaacctagtccgtcttagtacttcctaacctaaagtcggtaaactagttcggactaacgtagttacggaaacgacgacgggtaaccttaatttacttaagttgtaacgtaaccggtaaaagtcggttttacggttacgggtacgagttactaagttactaaaggttgtaggggtaacggttaggggtcgacccgtaacggaccgtaaccgggttggggacccgtaaggggaacctaccggtcggtaccaccggtttcctcctaccggcgcccttacccggaacccgaaccgggtccctaacggttccccggttcccgtttcccccgaggtcccctaccccgttcccgttaccgaccgacgtcccgtaaccccggg

SEQ ID NO: 43270 - DNA, 622 bp, Homo sapiens
  misc_feature: GYAE6OF01A1QP9.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgctatttanactaatttgatggaagtaataaaaattttcgacagactccgtgacggcattcaccatctcagacgacccttaccaaccatacgctagtactcctaccaaatcgaacagtcggtagactagttacgaacgacacggactaatttattatgtacgacgaaagtnttcgttaggtcgagtctatactaagtggtaggtagtggggtgtccgtacggtaccgaccggtacgggggaccaacggggtaacctacggttcgggtccacccgttcctaccctcgacgccctaccgaccgaacgggtccctagttcccggacctttcccccgcccgtaccgtccctaccccgttaccacccaaggccctaacccgg

SEQ ID NO: 43271 - DNA, 773 bp, Homo sapiens
  misc_feature: GYAE6OF01ERL0N.31.14.B03.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccaggcaagggactggagtggtgctatttanacatttgatgganaataaaaatttacgacagactacgtgaaggccattcaccatctaccagacgacccttaccaacctatacgctgtactctaccaaatcgaaacagtggtacgaacgtagttagaagacgacgggactaaactttaatttagttaggtacgtacggtaaagtagttttcggttacgggttaccgagtactaacgtacgtaaagttgggtagggtaacgttagggggttcgggtcctacggtaacccgtacccgggttcgggggaaccccgtaaagggggaaaccctaacgggtttacccgggtacccgttaaccccggttcccgttaccccgttacccgaacccggttacccccgttaccccggaaaacccccgaaccggggtacccccccgttaggttaccccccggggtttccccttttcccccccccggtaccgggtacccccctaaccccccgttacccccgttaacccggaaacccggtaccgtaccccgttaaccccccggg

SEQ ID NO: 43272 - DNA, 691 bp, Homo sapiens
  misc_feature: GYAE6OF01AG0VO.31.14.B03.1.454.CMB.1.raw
  modified_base (188)..(188): a, c, t, g, unknown or other
  misc_feature (188)..(188): n is a, c, g, or t
  modified_base (249)..(249): a, c, t, g, unknown or other
  misc_feature (249)..(249): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcactgggtccgccaggcccaggcaaggctggagtgggtgcatttanactaatttgataggagtaattaaaaaagttttacgactacgaacgtccggtaggaacgggaccgtacttcaacctactctaccaggaccgaccctttaccaaccataccgctacgtatctaccaaatacgaacgtagtcggtgactagttagaagacacggactaaactttattacttgacggtacgtaaagtactttcggttaggttcgagactactacgtaagtcggtggtagttagggtggtacgtacgaaccgtacggtacgggggacccgaagggaaccgtacgttcgggtcccgtaaccggttccctccgtaccgtaccgtccccgtacccgaacccgtaacccgggtccctaccgttcccggttccccgtttaccccccgtcgggtacccctaccccccgttaccctaacccggaacgaccgtccgtaccccggg

SEQ ID NO: 43273 - DNA, 728 bp, Homo sapiens
  misc_feature: GYAE6OF01DZSGH.31.14.B03.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggtttcctcgttgctcttttaagaggtgtccagtgtcaggtgctacctggtggaatcgtgggggaggcgtggtccggccgtggggggtccctgagactctcctgtgccatgtctgcgtctgaattcatccctnaggctactatcggcatgctacgtcgggccncgcggcccaggacgaagggactgggaggtgggtcggtataattttacgactaagtttgagtaggaagtaaaatttaaaaaacgttttacgacgtaacgaccgttaccggtaggaacgggtccgtaacttaccaacctactcctaccgaagtaacccgtaccccgtttaaccaacctactaccggtacttacgtaactacctaaccaaagtacgaaactagtgggtaacgactaagggtaacgaacgaaccgacggtaacttaacgtttatttacgtggtacgtaaagggtaaacgttagtttcgggttacggttacgaacgtactaagtaacgtaaggttacgggtaggtaggttaacggggtgtaccgtacgtacgaccgggtcgggaacgtacgggaacctacggtcgtaccgacgttccctccgactaccgcctaccgaacccgacggtccctagtccccttacgtcccccgtgacccctccgtaccaaccagcctccgtacgg

SEQ ID NO: 43274 - DNA, 808 bp, Homo sapiens
  misc_feature: GYAE6OF01CPF2U.31.14.B03.1.454.CMB.1.raw
  modified_base (549)..(549): a, c, t, g, unknown or other
  misc_feature (549)..(549): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtgggggtccctgagactctcctgtgccatgtctgcgtactgtaattcatcctcgaggctactagtggctagtcgacctacgtcggggtccccaccgacgggcccccgaagggaccgtaaacggggacgttaggggacgggttggggtacgtacttaagtttacttaaacctaagttttaggaagtaagggaaagttaaaaactttaaaaaacgttttccggacgtaacggtaccgttaccggtaagggaaccggggtcctaactttaccccgaacctagttacccctaccgaacgtacccgtaaccccttaccgaaacctacgttacgtacttacgtaacctcccgtaacctaaagtcaacgtagttacggacgtaagtaggtacgaactaaccgacgtacttaaacgtttnttacgttggacgtaagtaaggtttacgttcggttacggtacacgtactaagtacgtaaggtgggaggttaggtacgggtagaccgtaccgacggttaccgggcgggtaaccgtaacgggactaccgggttacgtacccgtcccgttcctaccgtactaccgaccccgtccgaaacccgtacggtcccctagttccccggttcccgttaccccggacccgtccccgtacccttcccgaacgtacgcccgtccgtaccggg

SEQ ID NO: 43275 - DNA, 715 bp, Homo sapiens
  misc_feature: GYAE6OF01B7XE0.31.14.B03.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (566)..(566): a, c, t, g, unknown or other
  misc_feature (566)..(566): n is a, c, g, or t
  modified_base (629)..(629): a, c, t, g, unknown or other
  misc_feature (629)..(629): n is a, c, g, or t
  modified_base (699)..(699): a, c, t, g, unknown or other
  misc_feature (699)..(699): n is a, c, g, or t
tcagcagtagacgtcacgaccggtgctcgatttagtgtgagtagtttgggctgagcgtgggttttcctcgttgctcttttaagaggtgtccagtgtcaggtgcacctggtggaatcgtggggagcgtggtccggccgtgggggtccctggagactctcctgtcgcctatgtctggcgtctgaattcatcctcaggcatagngcatgcacgtcgggccnccgacggccccgaggacgaacgggctgggtacgtgggtcgtctaatttatacgtaagtttggaagtaggtaaagtaaaatttaaaaaacgttttcgacctaacgtaccgtaccggtagggaacggtcgtaacttacaaccgtacttaccgtaccgaacgtacccgtaccccttaaccaaccgtacgtaaccggtactacgtactacctaaccgaaagtacgtacaaggtcgtagactagttaacgaagacgtaacgtactaaactttgttagttacgacgttaagtaagttcgttacgggtttacgtagtacgtatacgtacgtagttggtagggtacgttacggggngtcccgtaggcggtaaccgggtggaccggaagggtaacctcgtacggtcccttaccggtaccnccgtaccacggtcccacgaaccgaccgtccgtcttacccggttcccgtcccgacgccctaccctcgaacncgtcgtcccgtaccgg

SEQ ID NO: 43276 - DNA, 765 bp, Homo sapiens
  misc_feature: GYAE6OF01CATTO.31.14.B03.1.454.CMB.1.raw
  modified_base (226)..(226): a, c, t, g, unknown or other
  misc_feature (226)..(226): n is a, c, g, or t
  modified_base (497)..(497): a, c, t, g, unknown or other
  misc_feature (497)..(497): n is a, c, g, or t
  modified_base (620)..(620): a, c, t, g, unknown or other
  misc_feature (620)..(620): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtcctgagactctcctgtgaccatgtctgcgttctagtaattcactcctacgaggttactagtggctatcgcacggtcgggtccnccgacggaccccgaggacgaaagggtcgttgggaggtggggtcgacttaatttacgacttaagttgagtaggaacgttaaaaatttaaaaaacgtttcgaactaacggtacgttaccggtaagggaacggcccgttaattacccaacctactccgttaccgaacgtaaccgtaccccttaccaaacacttacgtctagttactacctaacctaaagtacgaatacgttgggacagtaggtaagaaccgaacgtacggtacttaaacgtttnttacgttaggagtaaaccggtaagttcgttttcggttaggttacgattacgactaagttaagttgggtagttaggtacgggtcgtctaccggaactcgggtaacggggacctaagggtacccncgggttccgtacccgtaccggttactcccgtacgaccgtccccgtaaccgacccggtaacggtcccttccgttacccggtttcccctccccgggacctaccctaccccgtaccgaccgaacgtccggccttaacccgggtcgggg

SEQ ID NO: 43277 - DNA, 741 bp, Homo sapiens
  misc_feature: GYAE6OF01BS1Z7.31.14.B03.1.454.CMB.1.raw
  modified_base (168)..(168): a, c, t, g, unknown or other
  misc_feature (168)..(168): n is a, c, g, or t
  modified_base (225)..(225): a, c, t, g, unknown or other
  misc_feature (225)..(225): n is a, c, g, or t
  modified_base (631)..(631): a, c, t, g, unknown or other
  misc_feature (631)..(631): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgttggtccggccgtggggggtccctgagactctccgtgtcnccatgtctgctctgtaattcattcctcaggcactatggcatggctacgtcgggtccnccgacggcccccgaaggccgaaagggtcctgggacggttgggtgccttaattttacaacgtaagttttgagttacggaagttaaacttaaaaaacgtttccgactaacgtaccgttccggtaaggaaccgggtccgttacttaccgaaccgttatcccgtaccgaacggtaccgtaacccccttacaacctacgtaccgtctagtaactccgtaaccaaattacgaacgtgtcgtacgacgtagtacgaaacgacgacgtacttaacttattacgttagacgtaacgtaaagttcgtttaggttcggttacgatactataacgtaggttgtaaggtaacgtgggtacgtaccgtcggtaaccgtccgggtcggggaccgtaacggaaccgtacgttacggtacccnccgttctccctacgtaccgtccgtaacccgaacccgtacgggtccccttacgggttcccttccccgttccccgacgtccctaccccgtctaccgacgtccgacgtcccgg

SEQ ID NO: 43278 - DNA, 731 bp, Homo sapiens
  misc_feature: GYAE6OF01A961J.31.14.B03.1.454.CMB.1.raw
  modified_base (91)..(91): a, c, t, g, unknown or other
  misc_feature (91)..(91): n is a, c, g, or t
  modified_base (499)..(499): a, c, t, g, unknown or other
  misc_feature (499)..(499): n is a, c, g, or t
tcagcagtagacgtcacgaccggtgctcgatttagtgtgagtagtttgggctgagctgggttttcctcgttgctcttttaagaggtgtccngtgtcaggtgcactggtggaatcgtgggggaggcgtggtccggcgtgggggtcctgagactctcctgtcgccatgtcgtggcgtctagtaatttcatcccgtacgaggaccactagtggctagtggcctaccggttccgggcccggccgaccgggacccctaagggacgtaaacggggcgttgggaggtcggggtggtctaagtttaataacgtaattgaggtaggaagtaaagttaaaaaattttcggaacgacgtacgtaccggtagggaacggtccgtaacttccaacctactctaccaaggtacctaacccttaccaaaccatacgtcttacgtactactacaaagtacgaataggttaggacgtactaaggtacgaagacgaccgtattaactagttgttagnggacgtaagtacgtttaggttggttacgtcggatatacgtagtagtaggaggttacgggtcgacgtccggtaacgtacccggtaggggaccgtaacgggaacgtaccggtacgacccgtccgtcccgtacgtccgtaccgccctaacccgacccggtaacggccctaaccggttcccgtacccgttcccgcccgtacccgtacccctcgtaacgccgtacgccctacccggg

SEQ ID NO: 43279 - DNA, 607 bp, Homo sapiens
  misc_feature: GYAE6OF01BDE5L.31.14.B03.1.454.CMB.1.raw
  modified_base (523)..(523): a, c, t, g, unknown or other
  misc_feature (523)..(523): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggcccccaggcgaagggactgggaggtgggtggctatttatactaatttgataggaagtaattaaaaaattttacgcagactccggtggaacgggccgtattcaccatctccagacgaccccttccaaccactacgctgtactctaccaaatgaacagtggtacgacagttagaagacgacggactaacttattagttgtagacgtaagtactttcggttggtacgagctagtcaagtggtaggagtagggtcgctacgacgccggtgggaccaagggaccacgtgtaccaccgttcctaccncgacgtccctaccgaccggtaccgggccctacgttccggtccccttccccgcgtccctaccctccgaacacggcgccgtaccgg

SEQ ID NO: 43280 - DNA, 810 bp, Homo sapiens
  misc_feature: GYAE6OF01B5OCI.31.14.B03.1.454.CMB.1.raw
  modified_base (223)..(223): a, c, t, g, unknown or other
  misc_feature (223)..(223): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtcgccatgtctgcgtctgtaattcagtcctcaggcactatggcagtgcaccgtcgggtcccnccgaaccggccccagggaccgaaaggggtacgtgggaggtggggtgtctaattttaacgaacttaagtttggtagtagggtaaagtaaatttaaaaaaacgttttaccgacgaacggtaccgttaccggtaaggaacgggtacccggtactttacccaaccgtacttcccgtacctaaccggaaccggtaaccccctttaaccccaaacccgtaacttaccggacttcgttactaccctaacgaaactagaactacgtaggtacgtactagttacggaaacgacacggaaaccttaacgttaagtttattacgggtagtaacggtaaaggttacgtttaccggtttagggtacgtagtacgtactacgtaacgttgtacgggtaggttacgggtacgtacggtaccgtaccgtaccgggtcgggaacccggtaagggaaccgtaccgttcggtacccgtacccgttcctccgtaccgcccgtaccgtaccccgacccggaacggtccccctaacggtccccgttcccgttcccccccgacgtccccctacccccgttcccaacccgacgtccgcccggttaccccgg

SEQ ID NO: 43281 - DNA, 772 bp, Homo sapiens
  misc_feature: GYAE6OF01B9Y0E.31.14.B03.1.454.CMB.1.raw
  modified_base (225)..(225): a, c, t, g, unknown or other
  misc_feature (225)..(225): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatcgtggggagcgtggtccggccgtggggggtccctgagactctcctgtgccatgtctgcgtctgtaattcactcctcaggcacttagtggccagtcgctacgtcggggcccnccgacggccccaggacgaagggtctgggagtggggtgacttatttacacttaagtttgagtaggaagtaaattaaaaactttcgacagtaccgtcggtaggaacgggcctattaccaccgtactccgtaccaacggtaaccgtaccccttaccaaacctactaccggtcttacgtaactacccgtaaacctaaagttacgaaacctagtacgggtactaaccggttaaggttaacgggaaacgaaccgaaacccggtaactttaaaccgttttaagtttaaccggtttaggttaacggaaacggttaagtttaacgtttcgggtttacggtacgtacggtaacttagtaacgtaaggttgggttaacggtagggttaaacgggtcgtacgtacccggacgtaaccgggtcgggaccgtaacggaacgttcgtacggtcctacccgtcctaccgtcgaccaccctaccgaaaccggtaccgtcccgtagttcccggttccccgtcccgccgacccctcccgtaccaacgtacgacgtcccgaaccggg

SEQ ID NO: 43282 - DNA, 720 bp, Homo sapiens
  misc_feature: GYAE6OF01C1P2M.31.14.B03.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (464)..(464): a, c, t, g, unknown or other
  misc_feature (464)..(464): n is a, c, g, or t
  modified_base (536)..(536): a, c, t, g, unknown or other
  misc_feature (536)..(536): n is a, c, g, or t
  modified_base (571)..(571): a, c, t, g, unknown or other
  misc_feature (571)..(571): n is a, c, g, or t
  modified_base (624)..(624): a, c, t, g, unknown or other
  misc_feature (624)..(624): n is a, c, g, or t
  modified_base (705)..(705): a, c, t, g, unknown or other
  misc_feature (705)..(705): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtccggcctgggggtccctgagactctcctgtgaccatgtctgcgtactgtaattcattcctnacggctactagtggcctaatcgactacgtgggtcccncgacggccccaggaccgaaaggggtacctgggaacggttcggggtacgtacgttaagttttaataccgtaaagtttttagaggttagggaaaagttaaattttaaaaaaaacgttttcgacgtaacgtaccgttacccggtaggaacggggtcctaattaccgtaccaattccgtaccgagttaacccgacccttacaacctacgtacgctactacgtcaacaatgacataggcacgngtagaacgtacacggtactaactttagttagtagtacgaacgttaagttcgtttacggttacggtacacgtntaacgtaactaaggtcggtaagtacggtaggggtntacctcggacgtaccggtgggaccaagggaactcgttgacccgtcgttacccncgttgaccgtcccgaacgaccggtacggccctaggttccccggtcccttacccgtcgaccctacccttgaaccctaccggngttacccgtacccgg

SEQ ID NO: 43283 - DNA, 762 bp, Homo sapiens
  misc_feature: GYAE6OF01D4X89.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcgtgggggtccctgagactctcctgtgccatgtctgcgtctgaattcatcctcaggctactagtggctatgcacgtcgggtcccgccgacggccccgaggaccgaagggtactagggaggttgggtcggacttaattttaagtaacctaaagtttagtaagtaaggtaaagttaaaaacgtttaaaaaacgtttaccgacgtaacgtaccgtaccggtaacggaacgggtaccgtacttaccaacctacgtacctaccgaacgtaacccgtaacccctaacccgaacctacgtaccgtacgttacgtactacctaaccgtaaacgtacgtaacgtagtacggtacgtaacgtaagtaacgaacgaacgacgtacttaactttagttagttagtagtaacgtaagttacgtttcggttaggtacgacgtactactacgtagttaggtaggtaggtaggtacgtaccgtaccgacgtacgggacgggacgaacggacgtacgtacgtaccgtaccgtcctaccgtaccgtaccgaccgtacccgaaccggacccggtccgtaccgtcccggttccccgtaccccgtaccgtacccctacccgtacccgtaccgaacgccgtccgtacccgg

SEQ ID NO: 43284 - DNA, 806 bp, Homo sapiens
  misc_feature: GYAE6OF01CZJZ0.31.14.B03.1.454.CMB.1.raw
  modified_base (187)..(187): a, c, t, g, unknown or other
  misc_feature (187)..(187): n is a, c, g, or t
tcagcagtagacgtcacgaccggtgctcgatttagtgtgagtagtttgggctgagcttgggttttcctcgttgctcttttaagaggtgtccagtgtcaggtgcacctggtggaatcgtggggaggcgtggtccggccgtgggggtcctgagactctcctgtgccatgtctgcgtctgattcatcctnaggcactagtggcatggcacgtcgggtcccaccgacggccccaggcgaagggctgggagtgggtgactatttacgtactaatttgagtaggaagtaattaaaaaatttcgacacgactaccggtaggaacgggtccgattccacctatcctaccgagaccgacccttaccaacctagtaccgtcttagtactccgtaaccaaagttcgaaactagttacggtagtaacgtaaggtttaacgaaacggtaccgaacggtaacttaaacgtttaacgttttagttacggtacggtaacggttaaagttacggttttacgggtttcgggttaacgacgtacgtaacgtacggtaaagtttcggggtaggttaacgggttacgggggttactccgttaaccggaaccgtaccgggttacgggggaacctaacggggaaaccgttacggttaccggtacccgtacccggttacctaccgtacccgtaaccgtccccaaccccgtaacccgggaaccggttcccccgtaccgttccccgggtttcccccttaccccccgggtaccggacccccttaaccccccggttacctaaccccggaaacgtcccgtaccccgttacccggg

SEQ ID NO: 43285 - DNA, 821 bp, Homo sapiens
  misc_feature: GYAE6OF01EMXMW.31.14.B03.1.454.CMB.1.raw
  modified_base (99)..(99): a, c, t, g, unknown or other
  misc_feature (99)..(99): n is a, c, g, or t
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggtttcctcgttgctcttttaagagtgtccagtgtcaggtncactggtggaatcgtgggggagcgtggtccggcgtggggggtccctgagacttctcctgtgccatgtctgcgtctgaacttcattcctgaggctactagtggctatcgcacgtcgggtacccncgacggtcccgaggaccgtaagggctgggaggtggggtgcttaatttagtaactagtttgacgtagggaaataaactttaaaaaacgtttcgacaacgtaccgtaccggttaagggaacgggtcctactttccaacctacgttaccttaccgaacggtaaccgtaccccttaacccgtaaactacggttaccgtaccgtttacgtaccttaccggtaaacctaaacggttaacgaacgtaggttaccggtagaaccgtaggttaacggaacgtaccgtaacgaactttaaacctttgttacgttagtacgtaacgtaaagtttacgttacgggtttcgttaacgagtacctaatacgtaaaggtttccggtagggttaacggtacggggttgtacccggtacgtacccgacggggttacggggaaccgtaaacggaaccggtacggttaccggtaccccgttacccggtacctaccccgtcgaccgtaccccgttacccgaaccgggttaacccggtcccgtaacggttcccggtcccccgtttaccccgacgacccccttacccgtcccgtaacgaaacgcccgttacgtaaccccgg

SEQ ID NO: 43286 - DNA, 731 bp, Homo sapiens
  misc_feature: GYAE6OF01EKUBO.31.14.B03.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (625)..(625): a, c, t, g, unknown or other
  misc_feature (625)..(625): n is a, c, g, or t
tcagcagtagacgtcacgaccggtgctcgatttagtgtgagtagtttgggctgagcgtggtttccgtcgttagctctttaagaggtgtccagtgtcaggtgcactggtggaatcgtgggggagcgtggtccggcgtgggggtccctgagctctcctgtgccatgtctgcgttctagaatttcacttcctcaggtcactagtggacngtcgcacggttcgggccnccgacggcccaggccgaagggtctgggtaggtgggtcgtacttaatttaccagttaagtttgaagtggtaaagttaaattaaaaacgttttcgactacgacgttaccggtaggaacggtccgtaacttccactacttccgaccgaagtacccgtacccttaccaacctacgtacgtcttacgttaactaccgtaactaaatcgaactagtcgggtacaacgtagtacgaacgacgtacggattaacgtttagttagttacgttacgaaggtaaacgtttcgtttacgggtttggtaacggactacgtatacggtaagttcgggtaggtaacggtcgggtcgtaccgtacgacgggcgtacggggacctaggaaccgtcggtccgtactcccgtcgtacccngtaccgtccctacggaaccgcccgggtaccctagggttccccttccccgtaccccggtcctaccccgttacctcccgtaaaccggtcgcccgttacctacccgggg

SEQ ID NO: 43287 - DNA, 763 bp, Homo sapiens
  misc_feature: GYAE6OF01E5PH2.31.14.B03.1.454.CMB.1.raw
  modified_base (497)..(497): a, c, t, g, unknown or other
  misc_feature (497)..(497): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtgggggagcgtggtccggcgtgggggtccctgagctctcctgtgccatgtctgccgtctagaattcactcctcgaggcactagtggcaatcgcctacgtcgggtcccgcccgacggcccccgagggacgaaaggggtctgggaggttggggtggcttaatttaactacgttaagttttgagtaggaaagttaaaatttaaaaacgtttcgacgtaacgtaccgttccggtaggaacggtccgtacttaccgaccgtactcctaccgaacgtaacccgtacccctacccgaaacctacgtccgtacttacgtacttacctaaccaaagtacgaactgtaggtactagtagtacgaaacgacgtacggtaacttaacgtttnttagttggacgtaacgtaagtttcgttcggttacggtacgtagtacctacgtagtaagtgggtagtagggtacggtccgtaccgtacggtaccgtaccgggtcgggaaccgtaaggaacccgtcggttaccgtacccgtacccgttctacccgccgaccgtaccccgtaacccggacccggaacccggtccctccggttccccgttcccccgtccccgtccggaccccctcccgtacccgtaaccgaccgtccgcccggtaccggg

SEQ ID NO: 43288 - DNA, 919 bp, Homo sapiens
  misc_feature: GYAE6OF01B7X02.31.14.B03.1.454.CMB.1.raw
tcagcagtagacgtcacgaccggtgctcgatttagtgtgagtagtttgggctgagcttgggttttcctcgttgctcttttaagaggtgtccagtgtcaggtgcacctggtggaatcgtggggaggcgtggtcccggccgtggggggtccctgagactctcctgtgccatgtctgcgtctgattcatcctcaggcactatggcatcggctacgtcgggtcccaccgacggcccccgaggccgaaaggggtccgtaggggtacggttggggttaggacttaattttagtaacgttaagttttgaagttaggtaaagtaaaaactttaaaaaaggttttaccgactaacggtaaccgttccgggtaacgggtaacggtacccggtaactttaccgacctaacgttcctaccgaacggtacccgtaccccttaaccaaccacttaacggtcttacgtacttcctaaacctaaagtacaactaggttacgggtactaacgtaaggttcgaaaacgtaccgaaaccggtacttaaacgttttagtttaagtacggttacggtaacgttaaaggtttacggttttacggggtttacggttaaccggaacgttacttaaccgttaaaggttaaggttaggggttaacggttaagggttacggggtaccggttaccgtaaccgggtacccgtaccggggtaccgggggtaacccggtaaaggggttacccccggtaacggttccgggtaaccccttaacccccgggtttcctaaccccgttccggaccccgtaccccgtacccgaacccggggtaacccggtccccttaccgggtttccccggttaacccccgtttcccccgaccgttaccccccgttacccggttaccccaacccgttaacgccccggtaacccggttaccccgggg

SEQ ID NO: 43289 - DNA, 873 bp, Homo sapiens
  misc_feature: GYAE6OF01B5OS5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactagtggcatgcacgtcgggccgccacggccccaggacgaagggactgggacggtggggtggactagtttatactaagtttgagtagggtaagtaaagttaaaaaaacttttccgactaacggtaaccgttcccgggtaggaaaccggggtcccgtaattacccgtaaccctaacttcctacccgaaggtaccgtaacccccttaccaaaccctagtaaccgtcgttacgttaacttaccctaaaccgaaagttacgtaaacgtagttacggggtacgtaaccgtaaaggttacggaaaaccggtaacgaaacccgggtaacttaaaacttttagtttaaacgtttacggttaacgggtaaacggttaaaagttcggtttttaccggggttacggggtttaacgacggtaacctaagttaaccgtaaaggttggggtaaggtaacgggttaacggggttcggaccccgttaacggtaaccgtacccggggtaggggacccgaaacgggtacccgtacggttaccggtacccgtaacccgttcccgtacccgttccgaaccgtccccgtaccccgtaacccggtaacccgggtccccttacggttccccgggtttccccctccccgtaccggacccccttaccccggacccttaaccggaacgtcccgcccgtaccggg

SEQ ID NO: 43290 - DNA, 811 bp, Homo sapiens
  misc_feature: GYAE6OF01CXWVH.31.14.B03.1.454.CMB.1.raw
  modified_base (721)..(721): a, c, t, g, unknown or other
  misc_feature (721)..(721): n is a, c, g, or t
tcagcagtagacgtcacgaccggtgctcgatttagtgtgagtagtttgggctgagctggttttcctcgttgcttctttaagaggtgtccagtgtcaggtgcaccgtggtggaatcgtgggggagcgtcgggtccggccgtgggggtcctgagactctcctgtcgccattgtctgtcgtactagtaattcacttccacgaggcacgtagtcgggactagtcgaccgtaccggtccggggttaccccgcccggaaccgggacccccgaggggtaacccggaaagggtcgtagggaggttcgggtagtactaagtttactacgtaagtttcgaattacgggaaataaaactttaaaaacgttgccgtaacgacgttacggtacggaacggacctacttaccaacctacgttaccgaccaagtacccgtaaccctttcgaaacctactaccggcttataactaccactaaaagtcgtaaaaggcgttagggaaccacggttaaagttacgaaaccgtaccgtacggttaaaaccctttaatttaaaggtttacgttacggaaacggtaaccggttaaattacggtttcgggtttaacggaacgtacggtaacttaagtaacgtaaaggttcgggaaggttaacggtcgggtacgttaccgtacggaccgtacggtacggggaaccgaacgggttacgaccggtcgtaaccgcccgttcgttaccncgtaacgtccccgacgtaaaccgcgacgttacccggtccctaccccggttcccaccggtccctaccccacgtaaccacgccgtcgtaccg

SEQ ID NO: 43291 - DNA, 805 bp, Homo sapiens
  misc_feature: GYAE6OF01C72P6.31.14.B03.1.454.CMB.1.raw
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (500)..(500): a, c, t, g, unknown or other
  misc_feature (500)..(500): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggagcgtggtccggccgtggggggtcctgagactctcctgtcgccatgtctgcgtctgaattcatcctnaggcactatggcatcgcacggttcgggcccncgaacggcccaggacgaaggctgggagtcgggtgactatttanactagttgataggagtaaagtaaaaatttagacagtaccgtccgtaggacggactacttacacctatacctacgaacgtaccgtaacccttaaccgaaaccacttacgcgttactactacctaaccaaatacgaacgtattgggacaagtagtacgaagtacaacggacttaaacgttattatacgtagaacgtaaaggttcgtttacggttacgggttacgtacgaacgttaaacgngttaaaagttcgggtaagggtaacgggttaacgggtaccggtacgttaccggaaccgggtacccgggtacgggggaacccgaaacgggggtaacctaccgggttaccggttaccaaccccgggtttcctacccggtcccgtaaccgtacccccgttaacccggaaaaccccggtaaaccgggtacccccgttaaggttttccccccgggttaccccgttacccccccggttaccggggtaaccccctacccccgttaaccccgtaaacggtaaacccgaaacccgttcccgggtaaacccccggg

SEQ ID NO: 43292 - DNA, 778 bp, Homo sapiens
  misc_feature: GYAE6OF01CL3LE.31.14.B03.1.454.CMB.1.raw
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtcctgagactctcctgtcgccatgtctgcgtctgaattcactcctcgaggctactatggcatcgcacgtcgggtccnccgacggcccgagcggaaagggcgtaggcgggtggtggcctaatttactaactaagtttgagtaggtaacgtaaaattaaaaaacttttccgactaacgtacgtccggtagggaacggccgtaataccaacctatccctacgacggtaccgtaccccttaccgaaactacttacgtacgttactacgtcctaaacaaacgtacgaaactaggtacggtactaacgaagttacgaaacgactaacgtactaaactttagttacgttagtacggtaacgttaaagtacgtttcggtaggttaccgagtactaatacggtaattggtaagggtacgttgggacgtccgtaacgggaccgtacgggtaaccgggcgaacgggtaaccgtacggtccggtacgtaccccggttataccccgtacgacccgtacccgtaacccggaacggtaaccccgggtccgttaaccggttccccgggttttaccccctacccccgggtacggtaccccccaccccgtttaaccccgaccggttaacgaccgtcccccggtaacccggg

SEQ ID NO: 43293 - DNA, 575 bp, Homo sapiens
  misc_feature: GYAE6OF01BEP1D.31.14.B03.1.454.CMB.1.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggcccnccaggcccccaggcaaggggactgggagtgggtggcatttanacaattttgatggagaataaaaaattttacgacagactccgtgaagggccgattcaccatcnccagacgacccttccaaccataccgctgtactctaccaaatgaacatggtagacagttagaagacacggactaacttattattgtagacgaaagtatttcggttggttcgagctaatcaagtgtggtagtagggtggctcggacacgtgggacagggacacgtgtcaccgtctcctcgacgccctccaccgaacgggccctagtccggtcccgttcccccgtggccctacccctccctacccaacgcgcctacccgg

SEQ ID NO: 43294 - DNA, 796 bp, Homo sapiens
  misc_feature: GYAE6OF01AHGYM.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcctggggggtccctgagacctctcctgtgccatgtctgcgtctgaattcatcctcaggcactagtggcctagtgctacgtcggggtcccgacccgacgggcccccgaggacgaaagggtctaggggaggttggggtcggtaccttattttaagtaacgtaagtttgaagtgggtaaacgtaaatttaaaaaattttccgactaacgtaccgtaccggtaggaacgggtcctaattcccaaccgtctcctacccaggtaaccgtaccccttaccgaaaccctagtaccgtcgttacgtaacttacctaacccgtaaagttaccggaaataacgggttcgggtacgtaaccgtaaggtttaacggaaacgaccggaacgtaacttaaactttacgttagttacggtaacgacggtaaacgttacggtttcggtacgggttacgacgtacgtactagtaacgtgggttggtacgtgggtacgaccgtacggaccggtacgggtccgggacgaacgggtaactccgttacggcccttaaccggttccctacccgtaccgtaccgtccccgtacccgaacccgggacggtcccctaccgttcccggttccccttccccccgaaggccccctacccccgtcacccgaacggccgtccccgtaacccggg

SEQ ID NO: 43295 - DNA, 995 bp, Homo sapiens
  misc_feature: GYAE6OF01CBC8O.31.14.B03.1.454.CMB.1.raw
  modified_base (224)..(224): a, c, t, g, unknown or other
  misc_feature (224)..(224): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcactcctcaggcactatggctatcggcacgtcggggtcccnccgacgggcccccagggacgaaaggggacctgggaggtggggtggctaatttaatacctaaattttggaagtagggtaaagttaaaagtttaaaaaaaacgtttttaccgaccgtaaaggtacccttaccggggttaggaaaccgggggtacccgtaagtttacccaacctaacttcccgtccgtaaaaccggtaacccgtaaccccccgtttaacccaaaaaccccgttaacttaacccggtaacctttaaccggttaacttaccctaaccctaaaacgtaacgaaaccgttaagttaacgggtacgtaaccgtaacggtttaaggaaaccggtaaaccgtacgggttaaaccttaaaactttttaagtttaagtttagggtacggtaacgggttaaaacgttaaggtttttccggggtttagggttaaaccgtacggttccgtaaagttaacccgtaaggtttagggtaaggggtacggtttaacggggggtccgtaccgtaccggtaacggtaccggggtacgggggtaaccccggaaaggggtaaccctaccggggtttacggccccgttaaaccccggtttcccgttccccgtaaccgttaccccgggacccctttaaaccccccggaaacccgggtaaccggggtccccccttaaacgggttttccccccggttacccccgtttacccccccggacgggtttacccccaacccccccgttaccctacccgggtaaacccgggaccctacccggtaaccccggggg

SEQ ID NO: 43296 - DNA, 773 bp, Homo sapiens
  misc_feature: GYAE6OF01ALTT5.31.14.B03.1.454.CMB.1.raw
  modified_base (641)..(641): a, c, t, g, unknown or other
  misc_feature (641)..(641): n is a, c, g, or t
tcagcagtagacgtcacgaccggtgctcgatttagtgtgagtagtttgggctgagcttgggttttcctcgttgctcttttaagaggtgtccagtgtcaggtgccacctggtggaatcggtgggggaggcgtggtccggccgtcgggggtccctgagctctccgtgtgccattgtctgcgttctagtaacttcacttccctcgaggcctacttagtggcatcgacctacggtcgggtcccgaccgaccggccccgaggacgaagggtcgtggggaggttcgggtcgacttaagttttactaacgttaagtttaggaagttaacggtaaagttaaaagtttaaaaaacgttttcgacgtaacggtaccgttaccggtaggaacgggtcctacgttacccaaccgtactacccgtaccgtaacggtaaccctaccccttaaccaaacctacgtaccgtacttacgttaacctactaacgtaagtacgtaacttacggtgacgtacgttagttaacgaacgtaccgtacgtaacttaagtttagttgtacgtagtacgtaacgttcgttacggttacggtacagtactagtaacgtagttaggtaggtagtaggcgacgacgcgacgggtcgacgaacggtaccncgtaccgtctaccgtctccgaccaccgtcccgaccgaaccgggtccgtcccgttaccggtccccgttcccccgttcccggacccctaccccgtccccgttacacccggtaccgacccggtcccggtaccggg

SEQ ID NO: 43297 - DNA, 829 bp, Homo sapiens
  misc_feature: GYAE6OF01DURPN.31.14.B03.1.454.CMB.1.raw
  modified_base (189)..(189): a, c, t, g, unknown or other
  misc_feature (189)..(189): n is a, c, g, or t
  modified_base (298)..(298): a, c, t, g, unknown or other
  misc_feature (298)..(298): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctnaggcactagtggcatgcacgtcgggtcccgccgacggcccccgaggacgaagggactgggaggtgggtgctatttatactagtttgatggaataattaaaaagtttcgntagactcgtagacggcgtatcaccactctaccacgaccgtacccttaccaacctataccgtctagtactaccgtaaccaacgtacggaacctagttagggtacgtaacgtaaggttaacgaaacgaccgtaaccgggtaaccttaaacgttttaattttagtttacggttacggtaacggtaaaggttacgttttcgggttttagggttacccggaagtaccgtacgttaacgtaagtttcgggtaagggtaacgggtttacggggtcggtaccgttacccgggtaacccggtaacccggggtcgggggtaacccgaaggggttaaacccgtacggttaccggtacccggtaaccccgttcccgttcccgtaccgtaccgtaccccctaaacccggaaccccggtaacccgggttacccctaccgggttacccccggtttcccccgttaccccccggtacccggttacccccccgtaccccccttacccccgtaaaccgtaaccgggtaccgtccccggttaacccccggg

SEQ ID NO: 43298 - DNA, 779 bp, Homo sapiens
  misc_feature: GYAE6OF01AU863.31.14.B03.1.454.CMB.1.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctctgtgccatgtctgcgtctgaattcatcctcagcactatggcatgcacgtcgggtccnccacggcccaggcaagggtacngggagtgggngctatttanactattgagtggaagtaattaaaaaacgttttcgactaacgacgtccggtaggaacggggtcctaacttccgacctaacttccgtaccaaggtaaccgtacccctttacccaaaccctagtaccgtcttacgttacttacccttaaccaaaacttacgaaacgtacgtagggttacgtaaccgtaaggtttaggaaaaccggtacccgtaaccgggtacctttaaaaccgtttaagtttacgttttacggtacggtaaccggttaaaggttacgttttacgggtttacgggtttacggaacgttacctaagtaccgtaaagttgggtacggtaaggtttacggggtacggtccgtaacggaccgtaccgggtacggggtaccaagggggtacctacgggtcggttacgacccgtcgcccttccgactcccgtaccgaccggtaaccggccctacgttcccgttccccgtaccccgtcgggtccctacccccgttccgaacccgaacgtccgcccgtaacccggg

SEQ ID NO: 43299 - DNA, 839 bp, Homo sapiens
  misc_feature: GYAE6OF01AWMMF.31.14.B03.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcatgccacgtcgggtcccnccacggccccagggcaagggactgggaggtgggtgctaatttanactatttgagtaggtaagtaaattaaaaaagtttcgactaacgaccgtaccggtaggaacggggtccctattacccgaacctacttaccgtacccgaacggtaccgtaaccccctttaacccaaacctagttacccggtacttacggttaactacccgtaaccaaaagttacgaaacgtaggttacggtacgtaacgtaggttacgaaacggtaccaacggtacttaaactttagttagtttcggtaacggtaacgtaaagttacgtttcgggttacgggttacgaacgtacgtaacgtaacgtaaggttgggttacgggtaaggttacggggtcgtaccgttacccggaccgtaccggggtacgggggaacccgtaagggggaaccctacggttaccgggtacccttaccccgggttcctaccgtaccgaccgtaccccgtaccccgaacccggttaaacccgggccccttaaggttccccccggttccccgttaccccccggtaccgggacccccctttaccccccggttacccgaacccgtaaccgggtcccgttaccccggtaccccgggg

SEQ ID NO: 43300 - DNA, 793 bp, Homo sapiens
  misc_feature: GYAE6OF01DNAMD.31.14.B03.1.454.CMB.1.raw
  modified_base (189)..(189): a, c, t, g, unknown or other
  misc_feature (189)..(189): n is a, c, g, or t
  modified_base (241)..(241): a, c, t, g, unknown or other
  misc_feature (241)..(241): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagctctcctgtgccatgtctgcgtctgaattcatcctnagcatagtggcatgctacgtcgggtccacgacggccccaggacgaagggcgnggagtggatggactatttacatattgagtagaataaattaaaaatttcgactagtacgtcggtaggaacggctatccactatccacaacgaccgtaaccctaccaactacgtacgacttacgtactacctaacctaaagtacgtaactaagtggtaactaacgtaggttaacgaaacgaccaacggttaactaaacgtttattaagttcgtaacggtaacgtaaaggttacgtttcgggttacggtacgtaatacgtaattacgtaaggttgggtaaggtagggttacggggtactaccggtaacgtacccggtaaccgggtcggggtaaccggaaaccgggtaacgtaccggttacggtacccgtaccgttcccgtaaccctacgtaacccgtaccccgtaacccgtaaacccgggtaacccggtaccccttaacccgggtttcccccgggtttaacccccccttacccccggtaacccgggtaacccccccttaacccccgtttaaccccggaacccggtttaaaacggaccccgggttaaccccccggg

SEQ ID NO: 43301 - DNA, 874 bp, Homo sapiens
  misc_feature: GYAE6OF01CV2PI.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatcgtgggggagcgtggtccggccgtgggggtccctgagacctctcctgtcgccatgtctgcgtctgaattcatcctcgaggcactagtggcagtgcctacgtggggtcccgaccacgggccccgaggcgtaaagggacgtgggaggtcggggtaggacttaagtttataactaagttttaggagtaggtaacgtaaagtttaaaaaaacgtttcggactaaggtaccgtaccggtaggaaacgggtccgtaacgttaccaccacttacccgtacctaacggtaacccgtaaccccttaccaaaccgtaacgtttaacgccgttacgttaacctaaccctaacgtaaaacgttacgtaaaactacgggttaggtaacgaaccggttaaaggttaggaaaaccgtaacgtaaccggtaacttaaaacgtttactttacgtaggttagaaaccggttaagttcgttttacgggttagggtaccgtagtacctaagttacgaaagtttcgggtaggtaacggtttacggggccgtaaccgtacccggtaaacggtacccgggtggggtaaaccccaaagggggtacctaacggttccgggtaaccctaccgggttccctaccgtaccgtaaccggtccccgtacccgaaacgggaaacccccggtccttaaaccggtcccccggtttccccttaaccccccggtcggaaccccctacccccccgttaactccccggaaaacgggtccctaaccccgggtacccggg

SEQ ID NO: 43302 - DNA, 875 bp, Homo sapiens
  misc_feature: GYAE6OF01AXVNJ.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggtttcctcgttgctctttaagaggtgtccagtgtcaggtgcacctggtggaatcgtgggggagcgtggtccggccgtgggggtccctgagactctcctgtgccatgtctgcgtctgtaattcatcctcaggcactatggctatgcacgtgggtccncacggccccaggcaagggactggagtgggtgactatttatactaatttgagtaggaacgtaaattaaaaaaagtttcgactaaggtaccgtccggtaggaacggggtacctacgtttaccaaccgtattaccaccgaacggtaccgtaaccccttaccaaacctacgttaccgtaccttaagttaccttacctaaacctaaacgttacgtaaacctacggttacggtacgtaaaccgttaagggtttaacgaaacggtaaccgtaaacgggtaactttaaacggttttaatttaacgttacgggtaacgtaacggttaaaacggttccggttttacgggttacgggtttaccgaagtaccgttaattaaccggtaaggttacgggttacggggtaaagtccgggggttaccgggtaccttaaccgggtaccgtaacccgggttacgggggaacccgtaaagggggtaaccccttacggggtaccggttaccctaacccggttcccttacccgtacgtacccggtccctaaacccgtaacccgggtaaaccgggtccccgttaaggttccccggttacccccgtttaaccccccggttccggaaccccccttacccgttaccccgaaacccgaacggtccccgttaacccgtaccccgggg

SEQ ID NO: 43303 - DNA, 844 bp, Homo sapiens
  misc_feature: GYAE6OF01CL6BM.31.14.B03.1.454.CMB.1.raw
tcagcagtagacgtcacgaccggtgctcgatttagtgtgagtagtttgggctgagctggattttcctcgttgctcttttaagaggtgtccagtgtcaggtgcacctggtggaatcgtgggggaggcgtggtccggccgtggggggtccctgagactccgtcctgtgccatgtctgcgtctgtaattcatcctcgaggctactagtggacagtggctacgtcgggtcccgccgacgggccccgagggacgaacggggacgtgggtagggtggggtacggacttattttaacgtaacttaaagtttggaagtagggtaataaaatttaaaaaacgttttaccgacgtaacgtacgtaccggtaggaaccgggtaccgtaatccgaacctacgtaccgtaccgtacgtaacccgtaaccccttaccgaaaacctacgtaaccgcttacgtaacttaccctaactaaaagtaccgaactagtacggtaacgtaacgtaaacggtaggaaacgaccggtaacgtaacttaaacgtttagtttaagtgtaacggtaacgtaaagttacgttttcgggttacggttacgaggacttaacgtactaaggttcgggttaagggtacgggttacgggtggtacccgttaaccggaaccggtaccgggtaaccggggggaacccgtaaaggggttaacctaccggggtttccggaacccttacccgggtccttcccgaccgtacccgtacccgtaacccggaaccccggtaccggggtcccttaccggccccggtttaccccctcccccggtcggtacccctaccccgttacccgtaaccgacggcccgtaccgg

SEQ ID NO: 43304 - DNA, 702 bp, Homo sapiens
  misc_feature: GYAE6OF01C1G5H.31.14.B03.1.454.CMB.1.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtcgccatgtctgcgtctgaattcatcctnaggacactagtggcatgcacggtcggccncgacggccccaggacgagggactggaggtgggtgactattatactattagagtaggaataattaaaaattcgacagtacgtcgtaggacggcgtactacgacctactctaccgagaccctaccttacccgaactactacgtctacgtactacctaacaaactactaacgtagtcggtatacgtaggtagaacgtacgacgtaacttaattagttagttacgtacggtaacgtaagttacgttacggttttaggaccgtaagtacctagttaacgtaggttagggtaaggttacgggtgggtacgtccgtacggaccgtaccgggtccgggaacgtaacgggacgtacggtcgtacccgaccgttcctcgaccgtacccgtaccccgtaccgaaccggaccgtccccgttaccggttcccggttcccccgtacccgtacccgtaccctaccccaccgtaccgaaccgccgtaaccgtacccggg

SEQ ID NO: 43305 - DNA, 1000 bp, Homo sapiens
  misc_feature: GYAE6OF01B0KP5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagtacctctcctgtcgccatgtctgccgtctagtaacttcactcctcgaggcactagtcgcagtgcctacgtcgggcccgccgaccggacccgaggtacgaagggacgtgggaggtcgggtagactaagttttacaactaagtttgaagtaggtaaagtaaaatttaaaaaacgtttaccgacgtaacgtaccgtaccggtaggaaccgggtacctaacgttaccaaccgtacttacccgtaccgaacggtaccctaaccccgtaaccaaaccacgttaccgtcttaacttacgtaccctaactaaacgtacgtaagagttcgggtacaacgttagtaacgaaacgtaccgtaaccggtaactttaaacgtttagttaacgttacggtaacggtaaaccggttaaacgttacggttttaccggttaggttaacggaccgttaaccgtaagttaacgttaaacggttagggttaacgggttacggttaacgggggttaccggttaccccgtaaccgggtacccggtaacccgggggttaccgggggaaaccccgttaaaccgggggtaaccctttaaccgggttcccgggttaaacccccgttaacccccggttttacccgtacccccgttaacccggttaacccccggtacccccggtaaaccccggtaaacccccggggttaacccgggtaacccccgttaccccgggttttaacccccccgggtttccccccgttaccccccccgggttacccggggttaaccccccccttaaccccccggtttaaacccccgtaaaccccgggtaaacccggttaaccccggaacccccggggtttaacccccgggg

SEQ ID NO: 43306 - DNA, 862 bp, Homo sapiens
  misc_feature: GYAE6OF01BTQ76.31.14.B03.1.454.CMB.1.raw
  modified_base (221)..(221): a, c, t, g, unknown or other
  misc_feature (221)..(221): n is a, c, g, or t
  modified_base (485)..(485): a, c, t, g, unknown or other
  misc_feature (485)..(485): n is a, c, g, or t
  modified_base (814)..(814): a, c, t, g, unknown or other
  misc_feature (814)..(814): n is a, c, g, or t
  modified_base (829)..(829): a, c, t, g, unknown or other
  misc_feature (829)..(829): n is a, c, g, or t
  modified_base (847)..(847): a, c, t, g, unknown or other
  misc_feature (847)..(847): n is a, c, g, or t
tcagcagtagacgtcacgaccggtgctcgatttagtgtgagtagtttgggcgtgagctgggttttcctcgttgctcttttaagaggtgtccagtgtcaggtcgcacctggtggaatcgtgggggaggcgtggtccggccgtgggggtccctgagactctcctgtcgccatgtctgcgtctgaattcatcctcgagactactatgcatgcacgtcgggtccnccgacggccccaggcgaagggactgggaggtgggtgcttaatttacaactagtttgacgtaggaaagtaaaattaaaaaacgtttcgacgtaacgtacccgtaccggtaggaaaccggggcccttaagtttacccaacccttacgtacccttacccgaaaggtacccgttaacccccctttacccaaaacccgtaacgttaccggtacctttacggttaactacccgttaacctaaaagtacggaaacgtacgttacgggtaanaccggttaagtaacggaaacgaaccgtaaccggtactttaaaactttagtttaacggttcggtaacggtaaccgtaaaaggtttccggttttaccggtttacgggttacgacgttaactagttaaccgtaagttcgggtaggtacgggttaacgggtcgtaccggtaccgtaacccggtaccgggtaccggggaaccgtaacggggaaacccttcggggttaccggtacccttaccggttccctaccccggttacgacccgtaccccgtaaccgaaccccgggtaacccggccctttaccgggtccccgttccccgtttaccccccggntaccccgtacccccnccgtaaaccgcggtaccncccggttaccccggg

SEQ ID NO: 43307 - DNA, 877 bp, Homo sapiens
  misc_feature: GYAE6OF01COYFA.31.14.B03.1.454.CMB.1.raw
  modified_base (162)..(162): a, c, t, g, unknown or other
  misc_feature (162)..(162): n is a, c, g, or t
tcagcagtagacgtcacgaccggtgctcgatttagtgtgagtagtttgggctgagctgggttttcctcgttgcttcttttaagaggtgtccagtgtcaggtgcaccgtggtggatcgtggggagcgtggccgccgtcgggggtcctgagctctcctgtgccntgtcgtgcgtctagtattcactcctgagctacgtagtcggcagtcgacgtcggtcgggtcccaccgaccggcccgaggaccgaagggcgtgggaggttgggagtactagtttaactatagtttgagtaaggtaaagttaaaatttaaaaacgtttcgactaacggtaccgttacgggacggtaacgggtccgttaacttaccccgaacccgttacgttccccgtaaccgaaccggtaaccccgtaacccccgtttaacccaaaccttacggtaaccgttacgtaccgttaactacccgtaactaaaacgttactaacgtacggttacggtacggtaacgttaaggtaacggaaacgtaaaccggtacccgttaaactttaaacggtttagtttaaggtaggtaacggttaaacggttaagtttaccggtttcggtttaacgggtaccaacggtacttaacgttacgtaagggtgggtaagggtacggtacggggtcgtaccccggtaacggacccgttacgggccggtaaacggtaccgggacgtaaccgtccggtaccctacccggtcctcccgaccgtccaccccgtaaaccggtacccggaacccggtcccgttacccggtttacccgttccccccggtaaccccggttcccggacccccttaacccggtacccgtaaccggtaaccggcccctcccgggttaaccccgggg

SEQ ID NO: 43308 - DNA, 901 bp, Homo sapiens
  misc_feature: GYAE6OF01B4F21.31.14.B03.1.454.CMB.1.raw
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtcgggtccgcacggccccaggcaagggctggagtgggtgctattanactaattgataggaagtaattaaaaaagtttcgacaagtacctacgtaggaagggtccctaagttaccacctaactcctaccgaacgtacgtaccccttacccaaaccacgtaaccgcttagttaacttaccgtaacctaaagtacgaaaccgtaagttcgggtaacgtaacgtaacggtttaacgaaaggaaccgtaacccgggtaacgttaaaaccttttaagtttaacgtttacgggtacgtaaccggtaaaaggtttacgttttacgggttacgggtttacggaacggtacctaaagttacctaaaggttgggtagggttaaacggttacgggggttacggtcccgtacggtaacccggtaacccggtacggggggtaaccccgtaaagggggtaaacccttaccgggttaacggggttaaccccttacccggggtttaccctacccgttacccggaaccgtaccccccgtttaaacccggaaaaccccggtaaacccggggggttaaccccccttaaacggtttcccccggggtttaccccccgttttaccccccccggtaccgggtaaccccccgtaccccccgtttaacccccgttaaccccgaaaacccgggtccggtaaccccccgttaaacccccgggg

SEQ ID NO: 43309 - DNA, 852 bp, Homo sapiens
  misc_feature: GYAE6OF01AEWW1.31.14.B03.1.454.CMB.1.raw
  modified_base (744)..(744): a, c, t, g, unknown or other
  misc_feature (744)..(744): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctacgaggcactagtggctatggccacgtgggtcccgccgacgggccccgagggtcgaagggtactggggagttggggtgctaatttagtaactaagttttgaagtacggtaaagtaaaactttaaaaaaacgttttccgacgtaacggtacccgttaccgggtaagggaaaccgggggtaccctaacgtttacccgaaacccgttataccccgtacccgtaaaggtaacccgttaaccccctttacccgaaaccgtaagtaccggtccttaacggtaacttacccgtaaccctaaagtacggtaaactacgttagggtacgtaaaccgtaaggttacggaaacgtaaccggtaaccgtacgttaaaccgttttattagttacgggtagtaaacgtaaacgttacggttttacgggttacggttacggaaggtacctaatacgttaagtcgggtaaggtaggttacgggtacgccgtaccgtacgtaccggggtcgggaccaaacgggtacgacgggtccggtaacccgtaccggttccctaccgtaccgtaacccncccgtaaacccggaaccgtaaccgggtccctaacccggttccggtaccccttcccccgggtacacccccgtacccttaccggaaccaaccggtccgcccggtacccgg

SEQ ID NO: 43310 - DNA, 940 bp, Homo sapiens
  misc_feature: GYAE6OF01AD1AZ.31.14.B03.1.454.CMB.1.raw
  modified_base (225)..(225): a, c, t, g, unknown or other
  misc_feature (225)..(225): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtggggggtccctgagactctcctgtgccatgtctgcgtctagtaatcactcctcgaggcactagtggcatgctacgtcgggtcccnccgacggcccgaggtacgaagggcgtgggaggtgggtgctatttatactaagtttgagtaggaagttaaattaaaaacgtttcgactaacggtaccgtccggtaggaaccgggtcctacttaccgaccgtactcccgtaccgaacggtacccgtaacccccgttaaccaaacccgtacgttaccgtaccgttacgttaaccttaccctaaccgtaaaagtacgtaaaccgtaggttacggtaacggtaacgttaaggtacggaaacggtaaccgtaccggtaacttaaactttagttaacgttaggtacggtaacgtaaacgttacgttttcgggttacggttacggaacgtacgtaacttaacgtaaggttggggtaacgggttaacggggttacgggggtaccgtaccggtaacccggtaaccggtacccggggttaacggggggaacccgtaacgggggtaaacccttaccggggtttacccgggtacccccttaacccgggttcccgttacccccgttaaccggaccccgttaacccccggttaaccccccgggaaaacccgggtaaccccggggttacccccttaacccgggtttacccccggtttacccccccgggttccccccccgggtaacggttacccccccttaacccccgttaccccgtaaacccgggaaacccgggtcccgtacccccggttaaccccggggg

SEQ ID NO: 43311 - DNA, 753 bp, Homo sapiens
  misc_feature: GYAE6OF01C62UJ.31.14.B03.1.454.CMB.1.raw
tcagcagtagacgtcacgaccggtgctcgatttagtgtgagtagtttgggctgagctgggttttcctcgttgctctttttaagaggtgtccagtgtcaggtgcacctggtggaatcgtgggggagcgtggtccggcgtgggggtcctgagactctcctgtgccatgtctgcgtctgaattcatcctagagcactagtggacagtgcacgtcggtccgaccacggcccaggacgaagggacgtgggaggtgggtcgattaagtttatacgtaagtttagagtaggtaagtaaaatttaaaaaacgttttccgataacgtacgtaccggtaaggaacgggtacctataccgacctagtacctaccgaacgtaaccctacccctaaccgaacctattacgtacttacgtactaacctaactaaactacgtaaactaggtaacggactaaggtagttaacggaaagaccgtacgtaacttaaacgtttagttaacgttagtagtaaacgtaagtttcgtttacgggtttagacggtactacgtaagtaactaggtaggtagggtacggttaggcgtacgtacggtacccgtacgggtacgggaacccgagggtaaccgcgttccggtcctaccgtctcccgtaacgcccgtaaccgtacccgaacggacccggtcccgtacgtttccccggtaaccccttccccggtcgtacccccgtaccccttacccgaaccgacccgcgttacccgtacccggg

SEQ ID NO: 43312 - DNA, 949 bp, Homo sapiens
  misc_feature: GYAE6OF01DA4QZ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtgggggtccctgagacctctcctgtgccattgtctgtcgtactgtaacttcatcctgaggactactagtggctatgcctacggtcgggcccacgaccggaccccgagggtaccgaaaggggtccgtggggtaggttcgggggtacgtacttaaagttttataacgtaagttttacggagttaaggtaaagttaaaatttaaaaaacgttttccgaactaacgtaccgtaccggtaggaaccgggtcctacttaccgaacctactctaccgtaacgaaacccgttacccctttaaccgaacctaacgttaccggtaccttacgtaacctaaccgtaaacctaaagtacggtaaactaaggttacggtaacgtacgtaaggttaacggaaacgtaacccgtacggttaaacctttaaactttaagtttacgtacgggtaacgtaaccgttaaaacggttcgttttaccgggtttacgggtaccggtaaacgttaccttaaaggttaaccgtaaagggttttaggggtaaggggttacggggttaacgggttcggttaaccccggttaccgggaaacccggtacccggggttacgggggaacccgtaaacgggggtaaccctacgggtttaccggtaccccggttacccgtttcccgttacccgtaccgttaaaccccgccccgttaaaaccccgacccggggttaaccccggtccccgttaccggtttacccccggttccccctttaccccccgggtcacccccgtttacccccaccgtaccccgtaaacgggcccttaaaccccggtcccgggg

SEQ ID NO: 43313 - DNA, 835 bp, Homo sapiens
  misc_feature: GYAE6OF01DJMQ5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtgggggtccctgagactctcctgtgccatgtctgcgtctgaattcatcctcaggcactagtggcatgcacgtcgggtccgccgacggccccgaggaccgaagggtcgtgggaggtgggtaggtactaagtttataactaagtttgagtaggtaaagtaaaatttaaaaacgtttacgacgtaagtaccgtccggtaaggaacgggtccgtacttaccgaacctatccgtaccgagtaccgtaccccttaccgaacctactaccgcttagtacctacctaacctaaagtacgtaaacgtagttaggtacgtaacgtaaggttaacggaaacgaaccgtaccggtaacttaaacgttttaagtttacgtttagggtacgtaaaggttaaaacgttcggtttttaccgggtttacgggtaacgacgtactaaaacgttctaaaggttgggtaagggtaaggttaccggggtgtacccgttaaccggaacccggttacccggggtaggggaaaccccgtaaggggttaaaccctccggttacgggaccccgttaccccgttcctacccgttacgaccccgtacccgtaccccgaaccggtaccggtccccttacgggtttcccccgttaccccgttccccccgtacggacccccttcccccttaaacccgtaccgtaaacgccgttccccggtaaaccgggg

SEQ ID NO: 43314 - DNA, 901 bp, Homo sapiens
  misc_feature: GYAE6OF01EP32M.31.14.B03.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggctggagctgggttttcctcgttgcttcttttaagaggtgtccaggtaggtcaggtgcacctggtggactcgtgggggagcgtggtccggcgtgggggtcctgagctcgtcctgtgccatgtctgcgtctagatttcactcctcgaggcactanggcatgcacggtcgggtccncgacggcccgaggcgaagggcgtgggaggtgggtgactagtttanacttaagtttgagtaggtaagtaaattaaaaagtttcgacacgtaccgtacggtaggaacgggcctacttacacctataccgaccgaacggaccctaccccttaccaaccgtactacgcttagttacctacctaacctaaatagaacgtagttaggtacgtacgtaaggttaacgaaacgtaccgtaaccggtaactttaaacgtttagtttacgttacgggtaacgtaaacggttaaacggtttaccgttttcggggtttaacggttacccggaagttacccgtaagttaacggtaaagggttggggttaagggtaaggggttacggggtaccgggtacccttaacccggggtaaccccggttaccgggggtaccgggggtaacccgggtaaaaccggggtaacccgttaacccgggttccgggttaaccccggttacccggtttacccttaaccccggtcccggtaacccgtacccccgggttaaaccccgaaccccggggtaaacccgggtcccccgttaaccgggttttccccccggtttacccccgtttccccccgggtaaccgtaccccccttaacccccggtaccccgtaaccggttaacccgcccggtacccgtaacccccgggg

SEQ ID NO: 43315 - DNA, 701 bp, Homo sapiens
  misc_feature: GYAE6OF01ATRPW.31.14.B03.1.454.CMB.1.raw
  modified_base (84)..(84): a, c, t, g, unknown or other
  misc_feature (84)..(84): n is a, c, g, or t
  modified_base (214)..(214): a, c, t, g, unknown or other
  misc_feature (214)..(214): n is a, c, g, or t
tcagcagtagacgtcacgaccggtgctcgatttagtgtgagtagtttcgggctgagctgggttttcctcgttgctcttttaagnggtgtccagtgtcaggtgcaccgtggtggaagtcgtggggggagcggtggtccggccgtcggggggtccctgagctctcctgtgccatgtctgcgttctgtaattcatccctcaggcactatggcatgcncgtcgggtcccgccacggccccaggcgaagggactgggagtgggtgctagtttatactaatttgagtggaagtaaattaaaaattttcgacagacctcggtagaacgggcctattccacatcctaccagaccgtacccttaccaaccataccgcttagtactaccaacctaaatacgaactagtggtagactagttagaacgacgacgacttaactttattagttgtagagtaagttagtttcggttaggttaccgagtccagtactaagtggtaggtaggtagggttcgaccgttcggaaccgtaccgggtacggggaccgaaggggtaaccacggttccgtacccgtaccgttcccttccaccgtccgtccccgtaccccgaacccggtacccgggtccctaccggttccccggtccccgtttacccccggccgttacccctacccccgtacccgtaccgaaccgtcccgtacccgtaccccggg

SEQ ID NO: 43316 - DNA, 714 bp, Homo sapiens
  misc_feature: GYAE6OF01CRR6R.31.14.B03.1.454.CMB.1.raw
  modified_base (418)..(418): a, c, t, g, unknown or other
  misc_feature (418)..(418): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgccacgtgggtccgccacggcccccaggcgaagggctgggaggtgggtggctatttatactaatttgaagtaggaagtaaattaaaaaaactttttaacggacctaagtaccgtaccggtaggaacggggtccgaattcgaaccaatcctaccacgtaacgaccccttaccaaacctataaccgcttcgtactcctacaaaatgaaactagtggtanaactagttagaacgaacgtacgggtacctaaacgtttaattattagttcgaagtaaaacgtagtttcggtttaggttacgaacgtcgtaagtacaagttggtagggtaacggttagggtggccgttacgaaccgtaaccggtcgggggaacccaaggggtaaccgaacgtgggttaccaccgtccgtcctaccgtacacccgtccaacccggaaccgggtaccctagtacccggttccccttcccccgtcggacctacccccttaacctaccgaaaacggtccgtctaaccccggg

SEQ ID NO: 43317 - DNA, 748 bp, Homo sapiens
  misc_feature: GYAE6OF01CRF1M.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccgacggccccgaggacgaacggggactgggaggtgggtcgactaatttactaactaatttgagtaggtaaagtaaatttaaaaaattttacgactaaggtaccgtaccggtaggaacgggaccgtaacttaccgaaccataccgtaccaacggaaccgtaccccttaccaaaccgtacgtaaccggtacttaggttaactaccgtaacctaaaacgtagtaaacctaagttcgggttaagaactaaggttaagaaacgtaaccgtaacgggtaacctaaacgtttattaagttacggtgaaacggttaaagtacgtttcgggttagttacgaagtactaatacgtaagtgtaggtagtaggtcgactcgacgtacgtgggaccgaaggactacgtcggtaccaccgttcctctacgaccgtcctaccgaccggaaaccggtccctaacgttccccgggttccccttcccccggacgtacccccgttacccccaccgttaacccggaacgtacccgtcccgtaccccggg

SEQ ID NO: 43318 - DNA, 825 bp, Homo sapiens
  misc_feature: GYAE6OF01D5O7D.31.14.B03.1.454.CMB.1.raw
  modified_base (560)..(560): a, c, t, g, unknown or other
  misc_feature (560)..(560): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcggtgggggagtcggtggtcccggccgtggggggtccctgagactcctccgtgtgcctatgtcgtgcgtctagtaactctatccgtacacggctaactagcgctagtcgaacgcggttcggcccgacccgaccggaccccgaggtacccggaagggtccgtaggggtaggttcgggtacggtactaaagtttttacgtaaaccgttaagttttggaaaggtaggtaaacgttaaaaagttaaaaaacgttttcgacgtaacgtaccggtaccggtagggaaccggtccgttactacctaacgtacgttacctaccgaacgtaacccgtacccttaacctaaccgtaacgtacgaccttagttactacctaacgaaacgtaacaacgtacgtggtacaaccgtagtacaaacgtaccaacgtaacctaagtttactaacggttaancggttaacgaacgttaacggttcgtttacggtacggtacgtaacgtactagtacggtaagtggtaacggtagtacggtcgaccgtacggaccggtaccggtacgggaacctaacggtaaccgtaccgtaccggttaccctacccgtaccgtacccgtaccgcccgaacccgtaccggtacccgtacccggtacccgtacccgttacccccggtacctacccccgaccgttacccctaccctacccggaccgaacgtccgtacccg

SEQ ID NO: 43319 - DNA, 835 bp, Homo sapiens
  misc_feature: GYAE6OF01BOM9K.31.14.B03.1.454.CMB.1.raw
  modified_base (226)..(226): a, c, t, g, unknown or other
  misc_feature (226)..(226): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagacttctcctgtcgccatgtctgcgtctgaattcatcctcaggcactagtggcatcgacaccgtcggggtcccnccgaccgggcccccaggccgaagggactgggacggtgggtggactagttttaactactaagttttgaacgtaggtaaagtaaaatttaaaaaagttttaccggactaacggtaccgttaccggtaggaaacggggtccctaagttcccgacctacttccacccgaacggtaccgtaacccccttaccaaaccctacgttaccgactacgttaacttcctaaccaaagtacggaaacagttagggtacaagtaggttagaacgtaccgacgtaacttaactttagttacgtttgtaggtaacgtaaaggttagtttccgggttaggttacccggaatacgtacgttacgtaaggttgggttaagggtaaggttacgggggtaccgtccgttaaccggaccccgggtaaccgggtccgggggaacccgtaacgggggtaacctaaccgggttaccgggttacccaccccggttaccttacccgtaccgccgtacccccggttaccaaaccccggtaccggtcccctaccggttaccccgttcccccgttacccccggcggtaccccttacccctaccccggtaccaaacgggtcccgtaacccgtcccggg

SEQ ID NO: 43320 - DNA, 712 bp, Homo sapiens
  misc_feature: GYAE6OF01DGWLP.31.14.B03.1.454.CMB.1.raw
  modified_base (163)..(163): a, c, t, g, unknown or other
  misc_feature (163)..(163): n is a, c, g, or t
  modified_base (620)..(620): a, c, t, g, unknown or other
  misc_feature (620)..(620): n is a, c, g, or t
  modified_base (692)..(692): a, c, t, g, unknown or other
  misc_feature (692)..(692): n is a, c, g, or t
tcagcagtagacgtcacgaccggtgctcgatttagtgtgagtagtttggctgagctgggtttcctcgttgctcttttaagaggtgtccagtgtcaggtgcacctggtggaatcgtggggaggcgtggtccggccgtggggggtccctgagacctctcctgtcnccatgtctgcgtctgaattcatctcaggcactagtggcagtgctacgtcgggtcccaccgaccggcccccgaggacggaaagggctggggaggttggggtacggtactaagttttataaccgtaagtttagagtaacgggtaaagtaaaatttaaaaaactttcgacagtaccgtccgtaggaacgggccgtaattaccgaaccgtactcctaccgacgtaacccgtaccccttacaaacccgattaccgtctacgtactacctacaaaatccgaatacggtaggtagtaacgtagggttaacgaaacgttaacccgacggtaactaacgtttatttacgtagtagaacgtaaagtcgtttacggttaggtacagtactaagtacctaagtggtaggacggttagggcgtacgtcgacgtcggttacgggaacgacggtaacgccgtgaccaccgtntaccctcgaccgtccacccgacgaacccgggtcctacgttcccgttcccgtccctcggtaccctccctaccncgaaacgtccgccgtacccg

SEQ ID NO: 43321 - DNA, 958 bp, Homo sapiens
  misc_feature: GYAE6OF01AGCF9.31.14.B03.1.454.CMB.1.raw
  modified_base (209)..(209): a, c, t, g, unknown or other
  misc_feature (209)..(209): n is a, c, g, or t
tcagcagtagacgtcacgaccggtgctcgatttagtgtgagtagtttgggctgagctgggttttcctcgttgcttcttttaagaggtgtccagtgtcaggtgcaccgtggtggaatcgtgggggagcgtggtccggcgtgggggtccctgagactctctgtgccatgtctgcgtctgaattcatcctcgaggccactatggacatcgcncggtcggggtcccaccgacggccccgaggacgaaagggctggggagttggggtgacttaatttacaacgttatttggacgttaggggtaaaataaatttaaaaaaacgttttccggactaacggtacccgttacccggaagggtaaacggggccccgttaatttaccccaacgttaaccgttcccttaaccggaacggtaacccgttaacccccctttacccgaaaaccttacgttaaccgtccgttacgttaacttacccgtaaccgaaaagttacggaaactaggttacgggttacgaaaccggttaaggttaacgaaacggttaaccgacccggttaaaaccgttttaaaacttttagttttaacggtttacggggtaacgtaaaccggggttaaacgttttaaccggtttcgggttttacggggtaacgtaacgtaaaccgtaagttaaccgtaaaggtttagggttacgggtaaagggttacgggtcggtacccgttacggaacccgggttaaccgggtcggggaacccgttaaacggggtacccgtacgggtttacccgtaccccgttaacccggttccgtttacccgaccgttaaaccccgggttcccttaaaccccccgggaaaccggtaaccccggttccccggttaacggttcccccgtttaccccgtacccccccggtaccgtaccccgtaccccccgttaccgtaaacccgtaaccggcccgtcccggtaaccccgg

SEQ ID NO: 43322 - DNA, 800 bp, Homo sapiens
  misc_feature: GYAE6OF01APHPN.31.14.B03.1.454.CMB.1.raw
  modified_base (180)..(180): a, c, t, g, unknown or other
  misc_feature (180)..(180): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggtcgtggtccggccgtgggggtccctgagactctcctgtcgcctattgtctgcgtntagaacttcactcctcgagctacgtagtggactatcgccgacgtcgggtacccaccgacggccccgaagggcgaaacgggcgtagggaggttgggcgtacttagtttaactaacgtaagttaggtagtaaggtaagttaaaagtttaaaaacgtttacggaccgtaacgtacggttaccggtaagggtaaccggtaccgtaacttaccacctacgtacaccgtaacgtaccgtaaccctaacctaacgtacgtacgtactactacgtacctaactaagtaaactaacgacgtttaggtacgaaccgtaaggttacgaacggtaccgtaaacggtacttaaacgttttaacgttagtacgttaacggtaacgtaagggttacgtttacggttcgggttaacgtacggtactaagttaacgagttagggtaggtacgtagggtacctacggacctacggtcccggtaacgggaacgttaacggaacctggtaccgtcgttacctaccgttacgcgtaaccctcccgaaaccggaccgtaccggtccctacgttaccccggttccctaccccggtaccgtacccttaccgaccctaaccggtaacgcccgttccgtaaccggg

SEQ ID NO: 43323 - DNA, 821 bp, Homo sapiens
  misc_feature: GYAE6OF01CQUHB.31.14.B03.1.454.CMB.1.raw
  modified_base (683)..(683): a, c, t, g, unknown or other
  misc_feature (683)..(683): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgtaattcatcctcaggcctaactagtggctatcgcacgttcgggccgccgacggcccccgagggaccgaaagggctgggaggtgggtgctatttatactatttgaagtaggtaagtaaaatttaaaaaacgttttacgaccgtaacggtaccgtaccggtaaggaacggggacccgtagtttacccgaacccgtagttccctaaccgtaacgacccgtaacccctttaacccaaaccctaacgttaccgtaccgttacgtaaccttacccttaaccgaaaaacgttacggtaaacgtaacgggttacgggtaacgtaacgttaaacgggtttacggaaaacgtacccgtaaaccggtaaccttaaaactttacgttttaagtcggtaacggttaaaccggtaaagttagttttccggtttagggttccgtagactaagtacgtaagttggtaaggtaggttagggcgtacgttaccgacgtaacccggtgggaccgtaaggtaacncgggttcgaccgttacccgtcctaccgtcgacccgtcccgtaacccgacggtaccggccccgttagttccccggttcccttccccccgtacggcccctacccccgttacctccgaaacgtccggtccccttacccggg

SEQ ID NO: 43324 - DNA, 900 bp, Homo sapiens
  misc_feature: GYAE6OF01BIPZ6.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtggggggtcctgagactctcctgtgccatgtctgcgtctagtaattcattccctcgaggcaacttagtggacagtcgcacgtcgggtcccaccgacggccccgagggaccgtaaggggtacgtgggaggtggggtcgtacttaattttaacgtaactaagtttggaagttaaggtaaagtaaaaatttaaaaaaacgttttacggactaaggtaccgttaccggtagggaaacgggtacccgtaattaccaacctacttaccgtaccgaacggtaacccgttaacccccttaaccaaaccgttaacgtaacccgtacgtttacgttaaaccttacctaaacccgtaaaagttaacggaaacgttaacggttagggtaacgtaaacgttaacgggttaaaggaaaaccgaaccggtaaccgggtaaactttaaaacgtttaagtttaggtttacgggtaacgtaaacggtaaagttttacgtttaccgggttagggttacgaagtacctaaagttacgtaaaggttgggttaaggtaaggttacggggtcaccggttaaccggacgtacccggggtacgggaacgtaaacgggtacctacgggtaccggtaccttaccggtccctaccgcgacccgtccctaacccggtaaacccggaccgggtcccttaccgggttcccccggttaccccttcccccccggtagaaccccccttaaccccgtaccccgtaaacgaacccggtacccgttacccgtaaccccggg

SEQ ID NO: 43325 - DNA, 836 bp, Homo sapiens
  misc_feature: GYAE6OF01CSRLI.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtggggggtccctgagactctcctggtgccattgtctgcgtctgaattcatcctnaggcactatggcatgccacgtcgggtcccaccgacggccccgaggacgaagggactgggaggttgggtgactatttatactaagtttgagtaggaagtaaatttaaaaaacgttttcgacagtacgtccggtaaggacgggcctattccaacctactcctaccgaaggtaaccctacccccgtttaaccaaacctaacgtaccggtacttacggtaaccttacctaacctaaaattacgaaactaacgttgggtaacgtaaccgtaaggttaaggaaacgtaacccgaccgggtaaacttaaagtttttactttagttacgggttacgaaaccggttaaagttccggttttacgggttttacggttaccggaacgttacgtaaatttaaccgtaaggtttgggtaacgggttagggttaacgggggtcggtacccgttaacggaaccccggtaccggggtaccgggggaaacccggtaaggggtaaaccccgttacgggttcccggttaaccgtaccccgttcgttccccgtacgtacccgacccccgtaccggaacccggtacccggaacccgttcggttccccggttaccctcccccgtacgaccccctcccgtaccctacgaacccgtcgacccgtacccggg

SEQ ID NO: 43326 - DNA, 869 bp, Homo sapiens
  misc_feature: GYAE6OF01BCMQ2.31.14.B03.1.454.CMB.1.raw
  modified_base (197)..(197): a, c, t, g, unknown or other
  misc_feature (197)..(197): n is a, c, g, or t
tcagcagtagacgtcacgaccggtgctcgatttagtgtgagtagtttgggctgagcgtgggtttccgtcgttgctctttaagaggtgtccagtggtcagggtgcacctggtggaatctggggggaggcgtgggtccggccgtgggggggtccctgagactctccgtgtgccatgtctgcgtctatattcactcctanaggctactagcggctagtcgacctaccggtcggggtacccgaccgaccgggcccccaagggacgaacggggacgttggggagggttgggggtggtaccttattttaagtaaccttaagttttggaagtaagggtaaagttaaaagttaaaaaacgttttaccggacgtaacggtaccgttaccgggtaggggaacggggtccccttaagttacccaacctacgtacccttaccggaacggtaaccctacccccttaaccaaaccttaaccgttaccgttaccgttacgttaaccgttaccctaaaccctaaagtacgtaaacccgtaggtttacgggtaacgtaccgttaaggttaacggaaccgtaccgaaaccggtacctaaagttttacttacggttcggtaacggtaacgttaacgtttaggtttaccgggttagtacgtacggactactagtaaggttcggttagggaaggttagggtcgtacctacggaaccgtaccgggtacgggtaccggaacgggtaacctcgggtaccggtcctaccgtccctaccggtcaccgtaccccgtaccgaacccggtaaccggtcccgttacgttcccggttaccccgtacccggtacccacccgtaaccctacccggaacccgacgaccgtaccgtacccgggg

SEQ ID NO: 43327 - DNA, 998 bp, Homo sapiens
  misc_feature: GYAE6OF01EUCJ7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtgccatgtctgcgtctgaattcatcctcgaggctactatcggcatgacctcgtcgggtccgaccgacggcccctaaggacgaaagggtaccgtgggtaaggttggggtcggaccttaattttaacgacgttaagttttgaagttacggtaaaggttaaactttaaaaaaagttttccggacctaaggtaccgttaccggtaagggaacgggtacccgttaatttccgaaccctacgttaccttaccgaacgtaaccctaacccccgttaccaaaccgtaaccgttaccgttacgttacgttaacctacccgttaacccaaaacgttacggaaaaccgttagttacggggttaacggtaacccgtaaggtttaaacggaaaccgtaaacggttaaacccgggtaaactttaaaaaccgtttttaaggttttaactttaggggttaaccgaacggttaaaacggttttagtttccgggttttagggttacgtaacgtaacgttaacgtaacgttaaggttgggttaagggttaacggttacgggggttacccggacccgtttaccggaacccggtaacccgggttacgggggaacccgtaaacgggtaacccgttaccgggttaccggttaccccgttaacccgttaccgtacccgttacccgaaccggtttaccccccgtaaccgggtaaacccccgtaccgggggtaacccccttaccgggttacccccgggtttaccccccttacccccgggttaacccggtaaacccccccttaacccccccgttaccggttaaacccccggtaaaccgtaccccggtcccgttaaacccccgggg

SEQ ID NO: 43328 - DNA, 720 bp, Homo sapiens
  misc_feature: GYAE6OF01E0VXB.31.14.B03.1.454.CMB.1.raw
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctnaggcactatggcatgcacgtcgggtcccnccgacgggcccccaggcgaaggggacctgggagtgggtgactatttanactaatttgataggaagtaattaaaaaatttcgacagtacctccgtaggaacgggccgtattccacctatcctaccaagaccgtaccccttaccaacctagtaccgtctacgtaacctctacccaaagttacgaaactagtcggtagaacgtaggttacgaacgtacacggactaactttaagttattgtaacgacgtaaagtcgtttcgggttagttacgacgactaagttacaagtgggttaggaaggttaggggtacgtccgtacgtaaccgtacccgggtggggaacccaaggggaaccctacgttaccggtacctaacccggttccctacccgtaccgaaccgttccctaacccggaacccgaaacggggtcccctaacggttcccggttccccttacccccgtcggacccttaccccgtaccctaaccgaccgtctcccgtaacccgg

SEQ ID NO: 43329 - DNA, 856 bp, Homo sapiens
  misc_feature: GYAE6OF01BVHCG.31.14.B03.1.454.CMB.1.raw
  modified_base (225)..(225): a, c, t, g, unknown or other
  misc_feature (225)..(225): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcgtggggagcgtggtccgcgtgggggtcctgagctctcctgtgccatgtctggcgtctagtaattcactccgtgacggctactagtggcatcgactacggttcgggcccnccgacggccccgaagggaccggaaagggtccgtaggggtacggttgggggtcgtactttaattttaactaacgtaagtttttaggaaggttaaggtaaaacgttaaaaacgttttaaaaaacgtttccggaccgtaacggttaccgttaccgggaacgggtaaccgggtaccgttaacgtcccgaacctaccggttacccgaaccgtaaacggtaacccttaacccccttaaccaaacgttacccgtacgtaccgttaacgtaccttacccgtaaaccgtaaagtacgaaacgttggtacggtacgtaacgtaaggttaaacgaaaccggtactaaacggttaaacttacttttaagttcggtacgttaacgggtaattagttacggtttcggttacgtacgagtacctagtacgtaggtgtaaggtgggtacggtacgtcgtaaccggacgtccggggtaggaaccggttaaggaccgtcggtccgtacctacccgttccgtaccgacgtccccgaaccctaccggtaaccgtaaaccccggtccgtacccgtttaccccgggtcccccttccccgtaacgtaccccgtaccccgtcgaaacccttacgggtccccgcccgttaacgggg

SEQ ID NO: 43330 - DNA, 883 bp, Homo sapiens
  misc_feature: GYAE6OF01BYK31.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtccctgagactctcctgtgccatgtctgcgtctagattcatcctcaggcactgtggcagtgcacgtcgggccgccgacggcccgaggtacgaagggtacgtgggaggtgggtcgtcgtaattttaacgtacgtaagtttgaagtagggtaaagtaaactttaaaaaagtttccgacgtaagtaccgttacgggtacggacgggtacctacttaccaaccgtactacctaccgaaggtaccgtaaccccgtttaccaaaccgtacgttaaccgcgtttacgtaaaccttcctaaccgtaaagttacggaaaccgtggttaacgggtacgtaacggtaggtttaaacggaaaccgtacgtaaaccgggtaacctttaaacgttgtttaaacgttggttaaccggaaggtaaaacgtttcggttttaccggttagggtttaccggaagtacgtaacgttaacgtaaggttagggtaacggtaacgggttacgggtacggttccgtaccgggtaaccgtccgggtaaccgggggtaccgaaacgggtaccgttacgggttaacccggtaccgttacccccgttcgttacccggtaccgaaccggttaccccctaacccgggaacccggttaaccccgggccctttaacccgggttccccgggttcccccctaaccccgggtcccggtacccttacccccggtaccgtaaaaccggtccgtccccgggtacccgttaccccggggg

SEQ ID NO: 43331 - DNA, 694 bp, Homo sapiens
  misc_feature: GYAE6OF01AXYQJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtggggtcccgccacgggcccccgaggacgaaggggactgggaggtggggtggactattttataactaatttggatggaagtaattaaaaaattttacgcaagtactccggtaggaacgggccgatccaccatcctaccagacgtaccccttaccaacctactacgcttagtactacctaccaaatacgaacgtagtggtacgaacgtagttagaacgacgacggactaacgtttattagttgtagacgtaagtgttacggttagggttacgaggtcaattacgaagtggtaggtaggttaggggtcggaccgttacgaccggtaccggttacgggggacccgtaaggggaacctacggtcggtaccctacccgttcctcccgtaccaccgtcccgtacccgaccgtaaccgggccctacgttccccggttccccttcccccgtacggcccctaccccgttcctaacccgagccgtcccgtacccgg

SEQ ID NO: 43332 - DNA, 845 bp, Homo sapiens
  misc_feature: GYAE6OF01BURM1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcaccgtggtggaatcgtgggggagcgtggtccggccgtgggggtccctgagactctcctgtgccatgtctgcgtctagaacttcaactccctacgagactacgtagtggctagtgccacggtcgggtcccgccgaccggccccgtaagggacgaaacgggtccggtagggtagggtggggtcgacttaagttttaacgaccttaagttttggaagtaagggtaaaagttaaaaaattttaaaaaacgtttcccgactaacggttacccgtccggttaaggaacggggtcccctaacttacccgaaacgtactacccgtaccgaaacggtacccgttaccccttaaccaaaaccctcttaaccggtcttacgtaacctacccgtaaacctaaaacgtacgtaaacctaagggttggtaaccgtaacgtaggtaaccgtaaacggaacccgtaacggtaacttaaactttaagtagttaggagtaacgtaaagtttcggttcggttaacgtcgataacgtattagtaagttggtacgtaggtaggtccgtacgaccgacggtaccgggcgggaccgtaacggtaaccgtacggtccggttaccgaccgttaccctaccgtaccgacctacccgtaaacccgtacccgggaaccggtcccgttacccgtttcccggtcccccttaccccgggtacgcccccttaaccgttccccaaaaccggtccgaacccgtcccggtaacccggg

SEQ ID NO: 43333 - DNA, 894 bp, Homo sapiens
  misc_feature: GYAE6OF01ERU46.31.14.B03.1.454.CMB.1.raw
  modified_base (161)..(161): a, c, t, g, unknown or other
  misc_feature (161)..(161): n is a, c, g, or t
tcagcagtagacgtcacgaccggtgctcgatttagtgtgagtagtttgggctgagctgggttttcctcgttgcttcttttaagaggtgtccagtgtcaggtgccacgtggtggaatcgtgggggagcgtggtccggccgtgggggtcctgagctctctgtnctagtgtctgcgtctagtaacttcacttcctgacggctaacttagtcggactagtcgacctaccggttccgggcccgaccgaccggccccgaaggaccggaagggtacgtggggacgggttgggtagtaccttaagttttaactaacgttagtttggaagttaagggtaaaatttaaaaacgttttaaaaaacgtttccgaacgtacgttaccgttaccgggtaagggaacgggtcctaactaccgaacctactaccgtaccgaacggtaaccccgttaccccttaaccgaaactacgttacgtcttacgtactacctaaacgaaatacgaacgtagtacgtagtacgtaagtaacggaacgtaccgtacgtaactttaatttagttacgtacggtaacggtaacgtaaaggtttcgtttacggttacggggtactacgtacttaacgtagttacggttaggggttaaggtaacggggttcgggtaacccggtacccggaacccggttaccgggtaaccggggtacgggaacccgggttaaacgggtaacccgttcggtttcccggtaaccccgttcccggttacctaccccggaccgtaacccgtacccccgaaccggtaaccgggaaccccggtcgttacccggttcccccggttccccccgtacccggtacccgtaccccccgttacccccgtaacggtaccgaaccgttcccgaacccggttacccggg

SEQ ID NO: 43334 - DNA, 850 bp, Homo sapiens
  misc_feature: GYAE6OF01ENKNY.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcagtgcacgtcgggtccgccacggcccccaggacaagggactgggaggtgggtggctattttaatactaagtttgagtaggaagtaaattaaaaaattttcgacaagtaaccgttccggtaggaacgggaccgtactttaccgaaccactccttacccgaacggtaccgtaaccccctttacccaaaaccctacgttaaccgcttacgtaacttaccgtaacccaaaatacgaaactagtacgggtacgtaacgtaggttaaggaaacgtaaccgtaacgggtaccttaaaccgttttaatttaacgtttaggtagaaacggtaaagttacggttttcggtttagggttacgtaggtactaacttacgtaagttgggttagggtaacggtttaggggtccgggtaccgttaccgggaacccgtaccggggttcggggaacccgggtaagggggaaaaccctaccgggttacgggtaccccgttacccggtttaccctacccgtaccgtaccggtaccccctaccccgggaaacccgtaacccggggtcccctaccggttaccccggtttccccttacccccccggtacggaccccccgttacccccgttacccaaacccgtaacggtacccgtcccggttaacccccgg

SEQ ID NO: 43335 - DNA, 609 bp, Homo sapiens
  misc_feature: GYAE6OF01BHCRT.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
  modified_base (432)..(432): a, c, t, g, unknown or other
  misc_feature (432)..(432): n is a, c, g, or t
  modified_base (499)..(499): a, c, t, g, unknown or other
  misc_feature (499)..(499): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtgactatttanactaatttgaagtggaagtaattaaaaaattttcgacaagacctccgtaggaagggccgattcaccatcctccagacgacccttccaacctntacgctgtactctaccaaatgaacataggtagacgtagtagaagaccgaacggactaaactttattagttgtagacgtaaagtntttcggttggtacgagacatcaagtgtagagtagggtgcctacgacaccggtgggaccaagggaacncggtcgtaccaccgttcctacctcgtacgccctaccgaacccgaacggccctagtcccggttccccttccccgcgaccctacccctcctaccgaacgtcgccgtacccgg

SEQ ID NO: 43336 - DNA, 789 bp, Homo sapiens
  misc_feature: GYAE6OF01B53WB.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtgggggagcgtggtccggccgtggggggtccctgagactctcctgtgccatgtctgcgtctagaattcatcctgaggctactagtggctagtcgctacggtcggggtcccaccgaccgggcccccgaagggacgaaacgggggtacgttggggaagggttgggggtacgtacttaattttagtaacttaagtttggaagtagggtaaactaaaatttaaaaaacgtttcggactaacggtaccgttaccggtaggaacgggcctacttaccgaacctatccgtaccgaacgtaccgtaaccccttaccaaacctagtaccggtacttacgtaactacctaaccaaagtacgaacgtagtgggtacaacgtaggtaacgaacgacgacgtactaatttattagttaggtacgaacgtaaagtttcgttacggttagtacgagtactaagtacgtaaggttggtagggtaacggtacggggtcgaccgttaccggaaccggtaccgggtaggggaacccgtaagggtaaccctcgggttacgaccgttacccttccgtaccctacggacccgtaccctacccgaaaccggaccggtccccttacggtccccggtttccccttcccgaccggtacccctaccccgtaccaacggacgttcccgacccgttacggg

SEQ ID NO: 43337 - DNA, 705 bp, Homo sapiens
  misc_feature: GYAE6OF01EJ45B.31.14.B03.1.454.CMB.1.raw
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgcacggccccaggcaagggactggaggttgggtgctatttanactaatttgatggaagtaataaaaattttacgacagactcgtagaaggccgatcgacatcncagacgacctcaacntacgctgtactcaccaatacaactactgtagactagttagaacgacgtacggacttaactttattagttggtagtacgtaaagtacgtttcgttggttacgagtaccgtaatacgtaaagtggttagggtagttaacggggtcgtacggtccgaaccggtaccggttcgggggaccgaacggggtaaccgtaccgttacgggttaccgaacccgttcccgttaacccgtccgacgtccccgttaccccgaaccggtaaacccgggcccgttaaccgtcccgggtttaccccgttcccccccgtacggacccccgtttaaccccccgttaccccgaccccgaaacgttaccccgggacccttacccccgggg

SEQ ID NO: 43338 - DNA, 810 bp, Homo sapiens
  misc_feature: GYAE6OF01EDW7Q.31.14.B03.1.454.CMB.1.raw
tcagcagtagacgtcacgaccggtgctcgatttagtgtgagtagtttgggctgagctggtttcctcgttgctcttttaagaggtgtccagtgtcaggtgcacctggtggaatcgtggggaggcgtggtccggctgggggtccctgagctctcctgtgccatgtctgcgtctgaattcatcctcaggcactatgcatgcagtcggcgccacggccccaggcgaagggactgggagtgggtcgcgtatttagactagtttgacgtaggtagtaattaaaaagtttcgacacgactccgtaggaaggtccgtataccacacgtacctccgaagacgtacccttaccgaacctagtaacgtctagtactcctacgaaatcgtaacagtcgtacgaagtacgttagaacgacgtacggacttaagtttacgttaagtttcggtataaccggtaaagtttaccggtttacggttttacgggttacggaacgttacgtaaacgtttacgtaaaggttaggggttagggtaaacggttacgggggtacggtacccgtttccggaaccccggttaaccgggacggggtaaccgtaaccggggttaaacccgttaccgggtaccgggttaccccgtaaccgttccccgttaccgtcccggtaaacccgtccccccgttacccgaacccgggtaaaccccgggtccccttaaccggttcccccggggttttcccccttcccccccgggtagtaacccccccgttaccccttaacccccggtaacccgtaaaacggggtccccaaccccggttaaccccggg

SEQ ID NO: 43339 - DNA, 840 bp, Homo sapiens
  misc_feature: GYAE6OF01BOYA0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgctacgtcgggtcccgccacggccccgaggacgaaggggacgtgggacggttggggtcggtactaattttaactaacgttaaagttttggaagttaggggaaaagttaaaatttaaaaaaaaacgtttttccggaacgtaaacggtaaccggtttacccgggtaagggtaaacggggtaccggtaactttacccgaacctacttacccgtaccgtaacggtaacccgtaaccccctttaaccaaaccctaagtaacccgtacttacgttaactacccgtaaccaaatacgaaacgtaagttacggtacgtaacgtaaggttaacggaaacgtaacgaacggtacttaaacgtttaattagtttacggtaggtaaccgtaaggtttagtttaccgggtttaggttacgagtactattaacgaaggttgtagggtagtagggtcgactacggacgtaaccgggtcgggaaccgaagggtaccacgttcgggtaccctacccggttcctacccgtccgtaaccgtccccttacccgaacccgggtacccggtcccttacccggttccccgggttccccttaccccggcggacccccttaaccccgtccctaaccgaacggcccgtccccgtaacccggg

SEQ ID NO: 43340 - DNA, 862 bp, Homo sapiens
  misc_feature: GYAE6OF01AX3T5.31.14.B03.1.454.CMB.1.raw
tcagcagtagacgtcacgaccggtgctcgatttagtgtgagtagtttagggctgagctgggttttcctcgttgctctttaagaggtgtccagtgtcaggtgcacctggtggaatcgtggggagcgtggtacggcctgggggtccctgagactcgtacctgtgccatcgtctgcgtctgaacttcactcctcaggtcactagtcggacatcgcgacgtcgggtccaccgacggcccaggcgaagggactcggagtgggtcgtctagtttactacgtaagtttgagtacggaagtaaacgttaaaaaacgtttccggactaacggtaccgttaccccggtaaggaaccgggaccctttaacgtttacccgaaccccgttaaacttcccggtaaccccgtaaacggtaacccgtaacccccgttttacccgaaaaccgtaccgtttaaccgggtacccttaagttaccgttaaccccttaacgaaaaccgttaggaaacccgttaaggtcgggttaacccgtaagttaaccccgggtttaacggaaaccggttaacccgtaaacccggggtaactttaaaaccggtttttaaccttaaggttcgggttaaacgtaaccggtaaaggttacccgtttaacgggttacggtttaccggaacggttactaacgttacgtaagttacgggtaggtaacgggtggtaccggtaccgttacgaacgttacccggtacgggccgtaaagggtcccaggttccgcgttaacccgtccgtactacgtacgccctaccgaaccgtacggcccctagttaccgtcccgttccccgaggtacccctacctacccgaacgacgaccgtccgtacccgg

SEQ ID NO: 43341 - DNA, 934 bp, Homo sapiens
  misc_feature: GYAE6OF01B8IWU.31.14.B03.1.454.CMB.1.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgcttcttttaagaggtgtccagtgtcaggtgcactggtgaatcgtggggagcgtggtccggccgtgggggtcctgagacctctcctgtgccatgtctggcgtctagtattcactccngacggcaactgtcgcagtcgacncggtcggccncgaccggccgaggacgaagggtacgtgggacggtggggtacacttaatttaatagttaaagtttgaagttaacggaaattaaaaattaaaaaagtttcgacgtaacgtaccgtacgggttaggaacgggtacctaacgttaccaacctacgttacccgacaacgtaacctacccttaccaacgtactaacgccttagtaacctaccaacgtaaagtaccgtaagtggttaagggtacaaccggtaaggttaacaaaaggtacccggtaaacgtaaaccttaaacggttttattacgggttaagtaacggtaaacggttaaacgggttttaacgtttccgggttttaaagggtcccggaaagttaacttaaacgggttaaaccggtaggtttagggtaacggggtaacgtttaaacggggggtccacctaaccggggttaggaaccccggggttacgggggaacccggaaacgggttaccggttacccggtaccggttaacccgtccccgtttcccgtacccgaaccgtccccgtaccccggtaaacccgggtaacccgggaaccccgggtttacctccccccggggttttacccccgtttacccgggttacccccccccgggtaaagttacccccccccccggttaccccgtttaaaaaccccggccggttaaaaacccggtcccccgggttaccgttaaccccccggggggg

SEQ ID NO: 43342 - DNA, 831 bp, Homo sapiens
  misc_feature: GYAE6OF01EU92S.31.14.B03.1.454.CMB.1.raw
  modified_base (238)..(238): a, c, t, g, unknown or other
  misc_feature (238)..(238): n is a, c, g, or t
  modified_base (288)..(288): a, c, t, g, unknown or other
  misc_feature (288)..(288): n is a, c, g, or t
tcagcagtagacgtcacgaccggtgctcgatttagtgtgagtagtttgggctgagcttgggttttcctcgttgctcttttaagaggtgtccagtgtcaggtgcacctggtggaatcgtgggggagcgtggtcccggccgtggggggtccctgagactctcctgtgccatgtctgcgttctagaatttccacttcctacgaggctaactagtcggacagtcggcacggtcggggtcccnccgaccggccccgaggacgaagggactgggaggtgggtgacttaatttanactaatttagagtaggtaaagtaaaacttaaaaaacgttttacgacgaacgtaccgtaccggtaggaacgggtacctacttacccgaacctacttacccgtaacccgaacggtacccgtaacccccttacccgaaaacctacgtaccgtacgttacgttactacctaacctaaatacgaactagtacggtacaagtacgtagaacgtaacgaccgtaacttaaagtttacgtttaaagttcggtaaggtaacgtaaaaccgggtttacgttttacgggtttaacgggtacgttaaacggtacctaaacggtttaagaaaccggtttagggttacggggtaaggttaaggggtaccggtaccgtaacccggaaccgtaccggggtaccggggaaccgtaaccgggtaaacctcgggtaacccgttccgtacccgttcctaccctcggaccctacccgacccgaacggtacccggtcctaccgttcccggtccttcccccgtagccccctacccgtaccaacccgaacgtcgaccccgtaccggg

SEQ ID NO: 43343 - DNA, 839 bp, Homo sapiens
  misc_feature: GYAE6OF01CHQDS.31.14.B03.1.454.CMB.1.raw
tcagcagtagacgtcacgaccggtgctcgatttagtgtgagtagtttgggtttaggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggcggccaccatcaactgacaacgtccacgaccagtagtttcgtttttacgttcccggaccccaaactaaacttaacctaaccttaacgttacgtcgtttacggtacccagacgaaaggaaagtacggaccacgccctaacccttaaaccttccgtagtacttttaccggcgggtcctttacccggtaccccgggtacgttacccgggtttaccccgggggttaccctaaaccggttacttacgtacgttcggaccgtacggggtccggggttccgtacggggtacccttcgtttacccactacctacccgaacctacgtaccgtacgaccgtaccgtccgtgaccggaggtccgtaggaacgtggtgtacggttactttaacggttttagtaccgttgtaccgtaacgtattaaccgtttaactttaccttttacccgttttaccgtttacccggttacctttacccgggggtttacggggtaaccgggggtacccgggttaaaccgggtaaggggttacggtaaaccggttaaacgttaaacccggtaaaacggttacggtacgggttccggtaccctccggtaacccttaacccgttggtttaccctttcggttaccctttaccggttaccccg

SEQ ID NO: 43344 - DNA, 1052 bp, Homo sapiens
  misc_feature: GYAE6OF01BMLVY.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcggtggtccggccgtcgggggtcctgagactctcctgtcgccatgtctgcgtctagtaacttcactcctcgaggctactagtcgctatcggactacgtcgggtcccgaccgaccggaccccgaggtacggaagggtaccgtggggacggttcggggtacggtacttaagttttaagtaacgttaagtttaggaaggttaaggtaaaggttaaaaactttaaaaaaacggttttccgaaccgtaacgtacccggttaccgggtaacggggtaaaccgggtaccccttaaccgtttacccgtaacccgtaaaccgttcccgtaacccccggaaagggtaacccccttaacccccccgtttaacccggaaaaacccttaaccgtttaaccggtacccgtttacgttaaaccctttaaccccgtaaaacctaaaacgttaaccgaaccggttaagttacggggttaacaaacggttaacggtttaaaccgaaacgtaaccggtaaaccgggttaaatttaaaccgttttagttaaccggttggttaaaccgggtaaacggttaaggtttaccgttttacgggtttacgggtacgtaaccgttacgtaacgttaacggttaagtttggggtaaggttaacgggttacgggtaccggtacccgggttacgtaacccgggtaaccggggtaaccggggtaacccgggtaacgggaacccgtttaccggttacccggttaaaccccgttaccccggttcccgttaccctaacccgggtaccccttacccccgtaaacccgggtaaaccccggtaccccgggtaacccctttccccggttacccccgggtttccccccgtacccccggttcggtaaccccccctaccccgggtacccttaaacccgacccgggttaaaccgtcccccgtaccccgggg

SEQ ID NO: 43345 - DNA, 929 bp, Homo sapiens
  misc_feature: GYAE6OF01BYNJW.31.14.B03.1.454.CMB.1.raw
  modified_base (181)..(181): a, c, t, g, unknown or other
  misc_feature (181)..(181): n is a, c, g, or t
  modified_base (913)..(913): a, c, t, g, unknown or other
  misc_feature (913)..(913): n is a, c, g, or t
tcagcagtagacgtcacgaccggtgctcgatttagtgtgagtagtttgggctgagctgggtttttcctcgttgctcttttaagaggtgtccagtgtcaggtgcaccgtggtggaatcgtgggggagcgtggtccggccgtggggggtccctgagactctcctgtgcctagtgtctggcgtntagtaattcactcctcaggcactagtggcagtgaccgacggttcgggtcccacccgaacgggcccccgaagggtacgaaacgggggacgttggggacgggttgggggtacgtacttaatttttacgttaaacttaagttttggaagtttaacgggtaaaagttaaaaattttaaaaaaacgtttttaccggaacgaaccggtaaccgttaccgggttaacgggaaaccggggtacccgtaactttaccgaacccgttaacttaccctaccgaacggtaacccgttaacccccttaacccgtaaacctaccgttaacccgtcgtttataaccttacctaaacctaaagtacgaacttagtacggtacgaacgtaaggtaacggaacgaacgtacggtaacttaacgtttagtttagttcggtaacgtaacggttaaaggttacgttttaccggtttaggttaacgtacggtacttaacgtaacttaaggttaggggttacggttaagggtcggggttacgtacccgtaccgggtaaccgtacccgggtacggggaacccggaagggaaccgtaacgggttaccggttaccgtaccccgttacccgtaccgacccgtaccggacccctaaccccggaaacccggttaccgggtaccccttaccggggttcccgttccccccggttccccgtacgtacccccgttcccctacccgttaacccgacggttaacccncccggttaaacccggg

SEQ ID NO: 43346 - DNA, 798 bp, Homo sapiens
  misc_feature: GYAE6OF01AKR01.31.14.B03.1.454.CMB.1.raw
  modified_base (182)..(182): a, c, t, g, unknown or other
  misc_feature (182)..(182): n is a, c, g, or t
  modified_base (501)..(501): a, c, t, g, unknown or other
  misc_feature (501)..(501): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggctgagcttgggttttcctcgttgctcttttaagaggtgtccagtgtcaggtgcacctggtggaatcgtgggggaggcgtggtcccggcgtcgggggtcctgagacctctccgtgtcgaccatgtctgccgtntagtaacttcactccctcgaaggcctaacgttagtggcagtcgaccgaccggttcgggtccccaccggaccggacccccggaagggacggtaaacgggcgttaggggcgggttggggtacgactttaagtttacaagttaagtttaacgagttaaggtaaaattaaaacttttaaaaaaacgtttccgacgtaaggtaacccgttaggaccggttaaacggcccttacttacccaaccttatacccgacctaaacggtaccctaacccttaaccaaccgacgtacgtacctagtactaaccgtaaacaaagtacgaacnggttacgaacgttacgttaaagtacgggaaanaccgttaaccgaaactttaaattaatttacggtagtaacgtaacgaaggttccgtttggttcggtacgaatacgtataagtagtaggtaacgagggtacggtcgtccgtacggacgtaccgggcggaacgaacggtcaccgggttactcctaccgtcctaccgcgaaccgtccgtaacccgtacggtaaaccccgtccgttccgtaccccggttccccttccggaccccttacctaccctacccgacctacgccgtaccctccgg

SEQ ID NO: 43347 - DNA, 792 bp, Homo sapiens
  misc_feature: GYAE6OF01CZ8QO.31.14.B03.1.454.CMB.1.raw
tcagcagtagacgtcacgaccggtgctcgatttagtgtgagtagtttgggtcgtgagctgggtttcctcgttgctcttttaagaggtgtccagtgtcaggtgcactggtacggaatcgtggggaggcgtggtccggtcctgggggtcctgagactctcctgtgcctatggtctgtcgtctagattcgatcctcgaggctactagtcgcatgacgacgtcgggtcccaccgacggacccccagggccgaaagggtccgtagggtacggtaggggtcggtactaagtttataacgtaattttggattaggttaagtaaatttaaaaaacgttttacgacgtaacggtacctaccggtagaacggggtcctacttaccgacctatcctaccgagtaccgtacccttaaccaacgtactaccggcttagtacgtacctaaccaaagtctaaacgagttacgggtagaacgtagtaacggaacgtaccgacgggtcttaaaactttacttaaggtcggtaagtaacggtaacgttcgtttaccggtttagggttacgagtacctattacgtaagttcggtaggttaggtaacgggtcggtcgtacggaccgtacgggtaccgggtaccgaacgggtaacgttccgtacggttcccgtaccgttacccgtacctaccgtaacccgtaccgttacccgaaccgggttaccggacccgtacggttcccgttaaccccgttcccctaccgggtaccccttaacccgttcccgtaacccacggtcccgtaccgtaccccggg

SEQ ID NO: 43348 - DNA, 825 bp, Homo sapiens
  misc_feature: GYAE6OF01EHEKN.31.14.B03.1.454.CMB.1.raw
  modified_base (177)..(177): a, c, t, g, unknown or other
  misc_feature (177)..(177): n is a, c, g, or t
  modified_base (231)..(231): a, c, t, g, unknown or other
  misc_feature (231)..(231): n is a, c, g, or t
tcagcagtagacgtcacgaccggtgctcgatttagtgtgagtagtttgggctgagcttgggttttcctcgttgcttcttttaagaggtgtccagtgtcaggtgcacgtggtggaatcgtgggggagcgtggtccggcgtgggggtccctgagactctcctgtgccagtgtctgcgtntagtaattcacttccctacgaggtcctatagtggcatgactacggtcgggcccncgacggcccgtaaggacgaacgggactagggaggttgggtcgtaacttaagttttaacaacttaagtttgaagtaaggtaaagtaaaaatttaaaaaacgttttcgacgtaacggtaaccgtacggtaacggaacgggtaccttacttaccgaacctactaccgtaccaacggtacctaaccccttacgaacctactacgtactacgttaactacctaaacgaaatacgaaactagtacgtagaacgtagtaacggaacgtaacgaacgtaccttaaagtttattagtaggtacgaagtaacggttacgtttacggtcggttaaggactagttaactagtaagtcgggttaagggtagtaacggggttcgaccgttacggaacccgtacgggtaacgggacgtaaccggtaacgtcggttacggtccctaaccggttctacccggtacgaaccgtaccctaacccggtaaaccgggtaaccccggtcccgtaacggtttaccccggtttcccccgttaaccccggtccgtaaaccccctacccccggtttaaacgaaaccccggtaacgtcccgaccccggtttaaccccgggg

SEQ ID NO: 43349 - DNA, 977 bp, Homo sapiens
  misc_feature: GYAE6OF01E2N1S.31.14.B03.1.454.CMB.1.raw
tcagcagtagacgtcacgaccggtgctcgatttagtgtgagtagtttgggctgagctgggttttcctcgttgctctttttaagaggtgtccagtgtcaggtgcacctggtggaatcgtgggggaggcgtggtccggcctggggggtcctgagactctctgtgcatgtctgcgtctgtaattcatcctcaggcactagtggcatcgccacgtcggggtcccgccgacgggcccccagggaccgaagggggacgtggggaggttgggggtggaccttaattttaacaacttaagttttggaatagggtaaagtaaaatttaaaaaaacgttttaccgacgtaacgtaccgttaccccggttagggaaaccgggggtccccgtaactttccgaaccctactttacccgtacccgtaaacggtaacccgttaacccccctttaaccccaaaaccctaacgttaacccggtactttaacggttaaaccttacccttaaaacccgaaaacgttaacggtaaaaccgtagttacgggggttaacgtaaacggttaacggtttaaggaaaaccggaaccggtaaaccgggtactttaaaccgttttaaagtttacgttacggttaacggtaacggtaaaagtttacggttttcgggtttacgggttacggacgtaacttaacgttaacgttaaggttcgggtaagggtaacgggttaagggggttccggtaccggtacccgggtaacccggtaccggggtacggggtaaccccggtaaaggggtaacccgtacgggtttaccgggtaccctaaccccgtttccgttaccctaccggtacccgtccctacccccggaaaccgtaccccggggtcccctaacccgggtttccccggtttacccccgttccccccggtcccgtaacccccgtacccccttacccccgggtaaccccgtaacggtaccccgtccccggtaaccccgggg

SEQ ID NO: 43350 - DNA, 816 bp, Homo sapiens
  misc_feature: GYAE6OF01BBUOD.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcatatggcatgcacgtgggtccnccacggccccaggacaagggctgggagtcgggtgctatttatacgaatttgagtaggaagtaaattaaaaagtttcgactagaccgttccggtaggaacgggcctaattaccacctatcctaccgaacggacgtaacccccttaccaaaccgtagtaccgtcttaggtaaccttccctaacctaaacgtacgtaaactaggttagggttacgaacgtaaggttaacggaaacggtaaccgtaaccgggtaaacttaaacgttttaagttaacggtttgggtacgaaaccgggttaaagtttacggtttaccgggttttacgggttaaccggtaagtaaccgtaagtttaaaccggtaaggtttacgggttaaggggtaaacgggtttaggggtaccgggttacccgtaccgggtaacccgtacccggggttaggggggaaccccgtaaggggaaccgtaccgttacgggtaccctacccgttcccgttaccacggtacctcccgtacctaaacccggaccgggcccttaccggtcccgggttaccccttccccggacgtacccaacccccttcgaacccgaacgtcgcccgttacccggg

SEQ ID NO: 43351 - DNA, 840 bp, Homo sapiens
  misc_feature: GYAE6OF01ESRGV.31.14.B03.1.454.CMB.1.raw
  modified_base (830)..(830): a, c, t, g, unknown or other
  misc_feature (830)..(830): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggccgtggggggtccctgagactctcctgtgccatgtctgcgtctgaattcatcctcgaggcactagtggacatcgacctacgtcgggtcccgccgacggcccccaagggaccgaaaggggacgttgggaagggttggggtaggtcttaagtttttaactaacgttaaattttaggaagttaaggtaaagtaaaattaaaaaaaagtttttacgaccgtaacgtaaccgttaccggtaacgggtaacggggacccgttaactttaccgaaccctaacgttacccgtacccgtaaacggtaacccgtaacccccctttaaccccgaaaacccgtaacgttaacccggtactttacgttaaacttacccttaaacccaaaagttaacgtaaaccgtagtacggggttaacgaacggtaagttaacggaacgtaacccgaacggtaacttaaacttagtttacgttaggtacgtaacgtaaagttcgtttacggttacggttacgtataaccgtatactaagtgggttacggtaagtcgggtagtccgtacgacccgtacgggacggggaccgaacgggtaccgtcggtacggtacccgccgtcctacccgtccaccgtccctaccgaaccgtaaccggtccctacggtccccggttccctcccccgtggacccctacccctctaaccccgacggtccnccgtacccgg

SEQ ID NO: 43352 - DNA, 891 bp, Homo sapiens
  misc_feature: GYAE6OF01CY26Y.31.14.B03.1.454.CMB.1.raw
tcagcagtagacgtcacgaccggtgctcgatttagtgtgagtagtttgggctgagcttgggttttcctcgttgctcttttaagaggtgtccagtgtcaggtgcaccgtggtggaatcgtggggagcgtggtccggccgtggggggtccctgagactctcctgtcgccatgtcgtgcgtactagacttcactccctacgaggcaacttagtcggacagtcgccacggttccggggacccgccggaccggaccccgagggaccggaaacgggtacgtgggagggttgggtcggacttaattttaacgtaacgttaagtttggtaacgtaagggaaaatttaaaaactttaaaaaacgttttaccgacgtaacgttaccgtaccggttaagggaacggtacccgtacttacctaacctactaccctaaccgaacgtaaaccccgtacccctaaccaaccgtaacgtaccgtcttagaacctttaccaacctaaagtgaaccgtagtcggataacgtaggtaacgaaacgtacccgtacgtaacttaaacgtttagttaacggttgaacggtaacgttaaacggttcggttttaccggttttaggtacgaagtctaactacggttaggttaggtaacgggtaggtacggggtccgtacccggtacggtacccggtaccggggtacggggaaccggaaccgggtaaccgtccgggttacgtacccgttacccgttcccgtaccgttacccgacccgtacccccttaccggaccccgggtaacccgtcccgttaccccggttcccccggtttaccccgcccccccggttaccggtaaccccccttcccccgtaaccgttaacccggacccgtaaccggtcccccgttaaaccggggg

SEQ ID NO: 43353 - DNA, 729 bp, Homo sapiens
  misc_feature: GYAE6OF01BMNU5.31.14.B03.1.454.CMB.1.raw
  modified_base (230)..(230): a, c, t, g, unknown or other
  misc_feature (230)..(230): n is a, c, g, or t
  modified_base (657)..(657): a, c, t, g, unknown or other
  misc_feature (657)..(657): n is a, c, g, or t
  modified_base (700)..(700): a, c, t, g, unknown or other
  misc_feature (700)..(700): n is a, c, g, or t
  modified_base (718)..(718): a, c, t, g, unknown or other
  misc_feature (718)..(718): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtggggggtccctgagactctcctgtgccatgtctgcgtctagtaattcactcctcgaggcctactagtggactagtcgccacgttcggggcccncccgacggcccccgaggccgtaaagggcgtgggaggttgggtcgtactaattttaacaacgtaagtttgagtaggaaagtaaattaaaaaagtttcgacaagtaccgttacggtaggtaacggccgtattaccgacctacttccgaccgtaacgtaccgtaccccttaaccaaacctagttaccgtcttagtactacctaacctaaatacgaaactaggtggtacgtaacgtagtaacggaagtaaccgacgtacttaaaactttagttaagtcggtaacggaaccgttaaagttcggttttaccggtttagggtaccgtaagtacgtaacttacgaaggttgggtaagggtacggtagggtccgtacgtaccgacggtaccgggtacgggacgtacggaataccgtcggtccaccttcgccctacnccgtcccaccgtaacgacccgtcctacgtcccgtcctccccgngtccctaccctcacgacncgtccctccgg

SEQ ID NO: 43354 - DNA, 868 bp, Homo sapiens
  misc_feature: GYAE6OF01D0WPW.31.14.B03.1.454.CMB.1.raw
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcagtgctacgtcgggtcccgccacggccccagggacgaagggcgtggaggtgggtgctatttanactattgataggtaagtaaattaaaaagtttacgacaacgtacgtaccggtaggaacgggtaccgtaacttccaaccgtactcccgtaccgaacggtacccgtaacccctttaacccgaaacctaacgttaaccggtcctttacggtaacttaccctaaacctaaaagttacgtaaactaggttacgggtacgtaaaccgttaaggttacggaaacgtacgtaaccgggtaacttaaacttttagtttaagtttcggtaacggtaaacggttaaacggtttacgttttacggggttttacgggtttaccggaaagtaacgttacgttaacgtaaaggtttgggtaaggggtttaacgggttagggggttacggtacccggttaaccggtaaccggtacccggggtaccgggggaaccgtaaacgggggtaacctaccgggttccgggttacccgtacccggttaccctacccgtaccgacccgtcccgtaaaccccgaccgggtaacccgggtcccctacggtttccccggttacccccgttaccccgtccggaacccccttaccccgttacccaacccggtaacgaccgtcccgtacccggg

SEQ ID NO: 43355 - DNA, 878 bp, Homo sapiens
  misc_feature: GYAE6OF01CN6WW.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggccgtggggggtccctgagactctcctgtgccatgtctgcgtctgaattcatcctcagcactatggcatcgcacgtcgggtcccnccgacggccccaggacgaaagggcgtgggaggtgggtcgacttaagtttataactaagtttgagtaggaaagtaaattaaaaaaacgttttcgactaacgtaccgtaccggtaggaacgggtccgtaattccaaccctatcctaccgaacgaacccgtaacccctttaccaaaccgtacgtaccgtacgtagttaacctacctaaccctaaaagttacgaaaacctaaggttcggggtaacgtaaccgttaaggttaacggaaacggtaacccggtaaacggttaaccttaaaacgttttaagttttaaggtttaggtacggtaaacggttaaaacggtttacgtttttaccgggttttacggggttacggtaaacgtccgttaagtaaccgtaaggtttgggtaacgggtaaggttaacggggtcggtaccgttaaccggaaccgtaaccggggtcgggggtaacccgaaggggtaacccgtacgggttccgtaccctacccgggttccctcccgtacgccgtacccctacccggtaacccggaaacccgggtccctaaccggttccccgggtttcccccttaccccccggtaccggtaccccccttacccccggtacccttacccggaaaaccggtcccgtacccggttacccccgggg

SEQ ID NO: 43356 - DNA, 680 bp, Homo sapiens
  misc_feature: GYAE6OF01AKADQ.31.14.B03.1.454.CMB.1.raw
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggggaggcgtggtccggcctggggggtccctgagactctcctgtgccatgtctgcgtctgaattcatcctcaggcactatggcatgcacgtggggtcccgccaggcccccagggcaaggggactgggagtggggtggctatttanactaatttgatggagaataaaaatttacgcagactccgtgaaggccatcacatctccagacgaccctccaaccataccgctagtatcctaccaaatcgaacatggtagactagttgaagacgacggataactttattattcgtagacgtaaagtcgtttacggttggttacgagactagtacgtaagtgggttagggaagttaggggtggtacccgtacggaaccgtacccgggttacgggggacccgaacggggtaaacccgtacgtaccgggttcccgtacccgttcccgttaccccgtacgtaccgtccccgttaccccgaaccgaaaccggggtcccctacggttccccggttcccctttcccccgtccggaccctacccccgtccctacccgaaacgtccgccgtaccccgg

SEQ ID NO: 43357 - DNA, 976 bp, Homo sapiens
  misc_feature: GYAE6OF01DR1A3.31.14.B03.1.454.CMB.1.raw
  modified_base (909)..(909): a, c, t, g, unknown or other
  misc_feature (909)..(909): n is a, c, g, or t
tcagcagtagacgtcacgaccggtgctcgatttagtgtgagtagtttgggctgagctgggttttcctcgttgcttcttttaagaggtgtccagtgtcaggtgcaccgtggtggaatcggtgggggagcggttgggtcccggccgtggggggtccctgacgaccttctcctgtcgcctattgtctgcgtctagtaacttcacttccctagacggcctaacttagtcggacctagtcggaccgtaccgggttccgggccccgaccgacccgggacccccggaagggtacggaaacggggtcggtaggggtacgggttgggtcgtacttaagtttactaacgtagttttgagtaaggaaagttaaaaacttaaaaagtttccgacgtacgtaccgttacggaagggtaaccgggtcctaacgttaccaaccgttctacccgtaacccgtaaggtaccccgttaaccccttaccgaaaccgtacgtaccggttcgttacctaacctacctaaacgtaaacgtacgtaaccttacgggtacggttaacgtaaccggtaagttaacggaaaccgtacgttaaccgttaaacgttaattttaggtttacgtttaaggtaacggtaacggtttaagtttacggttttcgggttaaccgttacgtaagttacccttaaggtacgtttaaagggtggtttaaacgggtggtttaacggggccgtaaccggttacccggtaaccgggtccggggttaacccgggaacggtaaaccgtaccggtttacggttcccggttaacccctcgttacccgttacccgtaacccgaaacccggttacccgaaaccccggttaacggtaccccggggttaacccttcccggggttttaacccccgttccccccttaccccccggggtnttaacccccccggttaaccccgttaccgaacccgggacccggttaacccgtcccgggttaccccggg

SEQ ID NO: 43358 - DNA, 893 bp, Homo sapiens
  misc_feature: GYAE6OF01ARL66.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctgggggtccctgagactctcctgtgccatgtctgcgtctgaattcatcctcaggcactatggcatgcacgtcgggtcccnccgacgggcccccaggaccgtaaaggggacctgggaacgggttggggtcggtacctaagtttttaacgtaaccttaagttttggaagttaagggaaaggttaaaactttaaaaaaaaagttttttaccggacctaacggtaacccgtttaccccgggtaggggtaaaaccggggtcccgttaacgtttaacccgtaacccctaacgtttcccctaaccccgaaaggtaacccggtaacccccttttaacccgaaaaccccgtaacgttaacccgtcccgtttaacggttaaacttcccttaaacctaaacgttaggaaaacctagttacgggtaacgtaacgtaggtttacgaaaaggtaccgaacggaccttaaacgtttattagttggtagtaacgtaaagagttttacggtaggttacaggtactaacgttacgtaagttgggtagtacgggttacgggtcgggtacctcgggaacctacccgggtacggggaccgtaagggaacctaccgttacgggtaccgtaaccccgttccgtaccgtaacccacccggtccttaccccccgaaacggtaacccgggtacccccgtaggtttaccccgggtcccctttaccccccggcggtaccccctacccgttcccccaccgaaaccggttcccgaccgtaccccggg

SEQ ID NO: 43359 - DNA, 651 bp, Homo sapiens
  misc_feature: GYAE6OF01AWZ7M.31.14.B03.1.454.CMB.1.raw
  modified_base (257)..(257): a, c, t, g, unknown or other
  misc_feature (257)..(257): n is a, c, g, or t
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
  modified_base (445)..(445): a, c, t, g, unknown or other
  misc_feature (445)..(445): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccagggccccaggcaaggggactgggagtgggtgctatttanactaatttgatggaagaataaaaaattttacgactaagactccggtaggaagggccgattacaccatccnccagacgtaccccttccaaccatacgctagtactctaccaaatgaacntaggtagacagttacgaagacacggactaacttattagttgtagacgaaagtatttcggttggttacganactatactaagttggtaggtagtagggtggacttcgacgtaccggtaggggaccaaggggactaacgtggtaccaccgttcctccgttccgacgtccctaccgaacccggtaacgggtcccctaggttcccgggtcccctttacccccccggtgggtaccccctacccccttaccctacccgaaacggtccgcccggtaaccccgg

SEQ ID NO: 43360 - DNA, 720 bp, Homo sapiens
  misc_feature: GYAE6OF01BZNE8.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactagtggacatgcacgtcgggtcccgccaggccccaggcaagggctggaggtgggtgctatttatactatttgagtggaagtaattaaaaacgttttcgactagtaaccgtccggtaggtaacgggtcctaacttccaccaatcctaccgagtaccgtacccttaccgaacctactaccgtcttacgtactcctacctaaactcgaactcgtacggtacgaactaggttacgaacgacgaccggtaactaactttatagttgacgtaacgtaaagtacgtttcggttaggttacgagtaccacgttataacgtggtacggtaaggtacgggtcgaccgttacggaccgtaccgggtacggggaccgaacggggtaaccctagggttaccggtaccgtacccgttccgtcccgtacgtaccgtccccgtaaccgacccgggtaaccggtccctacggttcccggttcccctcccccggtacggtacccctacccctacccgtaccgaacggtccctccggttaccccgg

SEQ ID NO: 43361 - DNA, 760 bp, Homo sapiens
  misc_feature: GYAE6OF01BAF39.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctgagactctcctgtgccatgtctgcgtctgaattcatcctcaggcactagtggcatgcacgtcgggtccgccacggcccaggcaaggggctgggaggtgggtcggctatttactactaatttgagtaggaagtaaattaaaaacgtttcgactacgacgtccggtaggaacgggcctaattaccacctacttaccgtaccgaacgtaccgtaccccttaccaaaccctaacgtaccggtcttacgtaacttacctaaccgtaaatacgaactagtacggtacacgtaaggttacgaagaccgtaacgtacttaaacgttattaagttacgtacgtaacgtaaagttacgtttacgggttggtacgacgtacattacgtaagttggtaaggtaggtacggggtcggtacctacggaaccgtccgggtacggggaccgaacgggtaactaccgggttacggtacccgtacccgttcctacccgtaccgacgtaccctacccgaaccggtaaccgggtcccctaggttaccccggttccccgttaccccccggtcgttacccccgtaccccgttccccaaacccggtaacggacccgtcccggtaaccccggg

SEQ ID NO: 43362 - DNA, 824 bp, Homo sapiens
  misc_feature: GYAE6OF01EAGFL.31.14.B03.1.454.CMB.1.raw
  modified_base (110)..(110): a, c, t, g, unknown or other
  misc_feature (110)..(110): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
tcagcagtagacgtcacgaccggtgctcgatttagtgtgagtagtttgggctgagctgggttttcctcgttgcttcttttaagaggtgtccagtgtcaggtgccactggngaatcgtggggagcgtggtccggcgtcgggggtcctagacgtactctccgtgtcgccatgtcngccgtntagtaattcatccncgagtctaactagtggactacgtgacgtaaccgtcgggtccgccaaccggccccgaaggacgaaagggtctgggtaacggtgggttacgataacgttttacagttaaatttcgaagtaggaaattaaaacgttaaaaactttagacgtaacgaacgtacgtacggaacggtaccagttacaacctactccgtaaccgaagtaacccgtaaccctaaccgaaactacgtacccgttagtaacgtaacctacttaacaaacgttaagaaccgtagttaggtaacgtaacggtaagtaaaccggaactaacgaaaccgtaacttaaaacgttaagtttagttacggaccgtaaggttaaacgtagtttacggtttacggtacgacgtaacgtagtacgtaattacgggtagttaacgtacgggtcgtacgttaccgaacggtacccgggtagggtaaaccccggtaaaggaaccttacggttaccggttacccgttacccggacccttacgtaacccgaaccgtacccgttaaaccgaacccggttaacccggcccgtttacggtcccggttacccgtaccccgtcgaccccgttacccctacaaacccggttacgaccgtcccgtaacccggg

SEQ ID NO: 43363 - DNA, 825 bp, Homo sapiens
  misc_feature: GYAE6OF01BIVZO.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggatcgtggggagcgtggtccggccgtgggggtcctgagctctctgtgcctatgtctgtcgtctagaatttcactcctcgaggctacgtagtggactatcgaccgtaccggttcgggacccgacccggacggaccccgtagggacgaaacgggtacgtgggacggttgggcgtacttaagtttactagttaagtttgaagtaaggtaaacgtaaaatttaaaaacgttcgacgacgtaccgttcggtagtaacgggactacttacgacctagtaccacgtacgaaccgttaccctaaccgaactacgtacgacgttacgtactaacctacgtaaagtacgtaactaggtagacgacgtagtacgaacggaaccgtaaggtaaccttaatttagtaggttaacgtacggtaaacgttaaacggtttcggtttacgttacgggttacaagttactaacgttagaaaggttgggtacgggtaacggtcgggttacgtaccgtacgtacggtacgggcggggtaacgtaaccgggtaactccggggttaacgtaccgtacccgttccgtacccgtagtaccccgtaccctaacccgggaacccggtaacccggtcccgttacccgggtttccccgtacccccgtttccccgggtacccaacccccgttaccccgtacccgaaaccggtttacccggaaccggcccgtttaaccccgggg

SEQ ID NO: 43364 - DNA, 670 bp, Homo sapiens
  misc_feature: GYAE6OF01CPGLQ.31.14.B03.1.454.CMB.1.raw
  modified_base (199)..(199): a, c, t, g, unknown or other
  misc_feature (199)..(199): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctgggggggtccctgagactctcctgtgccatgtctgcgtctgaattcatcctcaggcactanggtttcatgcacgtcggggtcccgccacgggcccccagggaccgaaggggctgggaggtggggtgctatttatactaatttgagtaggaagtaaattaaaaaacttttcgacagtaccgtccggtaggaacggggcctaattccgaaccatcctaccgagaccgtaccccttaccaacctataccgctacgtactacctacaaatgaactagtaggtacgactagtgaacgacacggtactaacttattagtagtagacgtaaagtatttcggttaggtacgagtctatactaagtgtaggtagtagggtcgactacgaaccgtacgggcgggaccgaacgggtacacggttcggcctaccgtcctaccgtcgaccgtccccaccgaccgaaccgggccctagttccccggttccctttccccccgaggccccctacccccgttccaccgaaccggccgcccttacccggg

SEQ ID NO: 43365 - DNA, 895 bp, Homo sapiens
  misc_feature: GYAE6OF01BGCUY.31.14.B03.1.454.CMB.1.raw
  modified_base (189)..(189): a, c, t, g, unknown or other
  misc_feature (189)..(189): n is a, c, g, or t
  modified_base (619)..(619): a, c, t, g, unknown or other
  misc_feature (619)..(619): n is a, c, g, or t
tcagcagtagacgtcacgaccggtgctcgatttagtgtgagtagtttgggctgagctggttttcctcgttgctcttttaagaggtgtccagtgtcaggtgcaccgtggtggaatcgtgggggagcgtggtccggccgtggggggtccctgagctctcctgtgcctatgtctgcgtctgaattcatcctnaggcacttagtggcagttcgcacggttcgggcccaccgacgggcccccgaggacgaaacgggggtaccgtggggtacggttgggggtcgtacttattttaagtaacttaaagttttggaattagggaaaggttaaaacctttaaaaaaagttttccggactaacggtaccgttaccggttagggaaacggggtcccgtaatttccgaacctacgttccctaaccgaaggtacccgtaaccccttaccgaaacctaacttaccggctttacggttaacctaccgtaaccctaaaaagttccgaaacgtaggttacggtacgtaaccgtaaggttacggaaaccgtaacgaccgggtaaacctttaaagttttaagttagtttacggtaggtaacgttaaaggttcgtttaccgggtttaggttcgaaacgnttaacgtacgtaaaggttgtaagggtagggttaagggtcaacccggtttacgggaaacccgtcccggggttacggggaacccgtaacgggggtaaaccctccgggtttcgggaacccttaccggttcctacccgttaccgaaccgttccccaacccggtaacccgggtaccggaccccgttccgttaacccggggttccccctttaccccccggggaccttacccccgtaccccccgttacccgtaaccgaaccggtccgtaccccgttaccgggg

SEQ ID NO: 43366 - DNA, 881 bp, Homo sapiens
  misc_feature: GYAE6OF01A9QQI.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctgaggcactatggacatgcacgttcgggcccaccacgggccccagggtcgaaaggggtactgggacggtggggtcggacttaagttttaacactaagtttgagtaggtaagtaaattaaaaacgtttcgactacgtacgtcggtacggaacggggcctattaccgacctactacctaccgaacgtaccgttaaccccttaccaaaccctagttaccgcgttacgttaactaccttaaacccgtaaagtaacggtaaacctaggttacggttaacgaaccggtttaaggttaaacgggaaccgtaaacccgtaaccgggtaaactttaaaaccttttaagtttaacgtttacgggttacgggtaacggtaaaggtttaccggttttaccggtttaggggtttaaccgaacgtactaacggttaccgtaaagggttcgggttaagggtacgggttacggggacccggttacgtaccggtaaccgaccccggggttggggaaacccggaacgggtacccgtaaccggggttcgtacccgttaccgtcccgttaccctaccgtaccgtaccccggtacccggaaaccggtaacccgggtaccccttacggtccccgggttcccccgttccccccggttcggtaaccccctacccccgttcccgtaaccccgaaaccggccggtacccctaacccgggg

SEQ ID NO: 43367 - DNA, 763 bp, Homo sapiens
  misc_feature: GYAE6OF01EC75E.31.14.B03.1.454.CMB.1.raw
  modified_base (269)..(269): a, c, t, g, unknown or other
  misc_feature (269)..(269): n is a, c, g, or t
tcagcagtagacgtcacgaccggtgctcgatttagtgtgagtagtttgggctggagctgggtttcctcgttgctcttttaagaggtgtccagtgtcaggtgccacctggtggaatcgtggggagcgtggtccggccgtgggggtccctggagacctctcctgtgccatgtctgcgtctgaattcatcctcacggtcactagtcggcatcgctacgtcggggtcccgccgacggcccccaggccaagggctgggagtgggtgctatttanacatttgagtggtaagtaattaaaaagtttcgactagacctccgtagaagggcctagttccaccatctccgagaccgtacccttaccgaaccataccgtctagtactcctaccaaagtcgaacctagtacggtacgtactagttacgaacgaccgacggactaaacgtttattagttacgtagtaaccgtaaagtcgtttacggttaggttacgtaagtactacgtacgtaagtcgggttaggaagttacgggggtcgtaccggtaaccggtaccgtaacccgggtgggggaacccgtaacggggtaaaccaccgggtttacggtaacccgttacccggttaccttccccgtaacgtacccggttacccgtacccgtaaacccggtaaccggggtcccccctaaggttcccccgggttacccgttacccccccggtaggacccccttaacccccgtacccttaacccgaaacggtccgtcccgtaacccccggg

SEQ ID NO: 43368 - DNA, 1000 bp, Homo sapiens
  misc_feature: GYAE6OF01COJYV.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtgggggagcgtggtccggccgttgggggtccctgagactctcctgtcgccatgtctgcgttctagtaattcacttccctagacggccaacgttagtgggaccattcggacctaacgggttccggggtccccgacccggaacccgggaccccccgagggtaccggtaaaacgggggccgtttagggggtaacgggttgggggtacgtacctttaaagtttttaacaaacgttaaagtttttaggaagttaagggttaaaagttaaaaagttttaaaaaaaacgtttttaccgaaccggtaaacggttaccgttaacccgggtaagggtaaaccggggtacccttaactttaccccgaaacccttaacgtacccgtaaccccgtaacggtaaccccgttaaccccctttaacccgaaacccttacgttaacccgttaccgttacgttaaccttaccctaaaccgtaaaacttaggtaaaccgttaggttacggtacgtaacggttaaggttaaacgaaacgttaaccgaccggttaacttaacgttttaaacttagttacgtaccggaaagttaacgtttacgtttacgggtttacggttaacgtaacgttaaccgtaattaaccgttaaggttacgggtagggtacgggttacggttcggaccgttaccggaacccggtacggggttacgggaacccgggaacgggttacccggaaggtttcccggcccgttaacccgttcctaccctaccgacccggtccccaaaccccggtaaccggaacccggttcccgtacccggtttaccggttcccccccgtccccgtaccccggacccccttaacccctacccgttaaccgaaacccggtccgaacccccgttcggg

SEQ ID NO: 43369 - DNA, 719 bp, Homo sapiens
  misc_feature: GYAE6OF01D2K5C.31.14.B03.1.454.CMB.1.raw
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
  modified_base (576)..(576): a, c, t, g, unknown or other
  misc_feature (576)..(576): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagtcgtggtccggcctggggggtccctgagactctctgtgccatgtctgcgtctgaacttcatcctcgaggcactatggcatcggcctacgttcgggcccnccgacggccccagggtcaagggctgggagtgggngactattanactattgattaggaagtaaataaaaatttcgactagtactcgtagacggcctatcacattcaccagtacctaccctacgaactntacgcttagtactctaacaaagtgaactaggtcggtanaacgtagtacgaacgtaccgacggtacttaaacgtttnttagtacgggagtaaacggtaaggttacgtttcgggttacggttcgaatctaattcgtaaggttcgggtaggacttaggggccgacgtaccggaaccgtaccggggtcgggtaaccgtaacgggaccttaacgggttcccggttaacccnccccggttacctcccgttaacgccccgttaacccgaccccgtaaaccggacccgggtccccttacggttccccggttaccccttccccggtacgtacccccgtaaccctcggtaacccaacggggtcctaccccggtaccggg

SEQ ID NO: 43370 - DNA, 716 bp, Homo sapiens
  misc_feature: GYAE6OF01DGPG7.31.14.B03.1.454.CMB.1.raw
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcgtggggagcggtggtccggccgtggggggtccctagagtacctctccgtgtcgcctattcggtctcgccgttctagtaacttcacgtcccgtacgacggactacgttagtcggacctagtcgacgtacggtcgggcccaccgaccggcccgtaggacggaaggtcgtgggnggtgggtacgtactattttagattagttgagtaggtaaataaaattaaaacgttcnctaacggtacgtacgtacggacggtaccgtataccgactactcctacgactaccgtaccctacaactctacgcttatactacctaacataacgacngttaggctagtagtaacacgtaacgagtactaagtttattagtgtaacgagtaagttagttcggtagtccgatataagtcgaggtttcgtaggtggtaccggtcgtacggtaccgaaccgggtcgggaggaacccgtaaggtaccgtcgttaccggtccgtaccgttaccctccgtactacccgcccgtaccggaactacccgggttcctacccggttccccttcccgaccccggtcccacccgtacccgttacccagtacggtacccgctaccggg

SEQ ID NO: 43371 - DNA, 811 bp, Homo sapiens
  misc_feature: GYAE6OF01CLUS5.31.14.B03.1.454.CMB.1.raw
  modified_base (787)..(787): a, c, t, g, unknown or other
  misc_feature (787)..(787): n is a, c, g, or t
tcagcagtagacgtcacgaccggtgctcgatttagtgtgagtagtttgggctgagcttgggttttcctcgttgctcttttaagaggtgtccagtgtcaggtgcacctggtggaatcgtggggagcgtggtccggccgtggggggtccctgagactctcctgtgccatgtctgcgtctgattcatcctcaggcactatggcatgcacgtcggggtcccgccgacggcccccgaggacgaacggggtcgtgggaggtggggtggtactaattttataacctaatttaggaacgttggtaaagtaaaatttaaaaaaacgttttcgactaacggtaccgttaccgtagggaacgggtcccggtaattaccccgaacctacgttacctacccgaaggtaaccccgttaacccccctttacccaaacccgttaacgttacccggtacctttacggttaacctttcccgtaaacccgtaaaagtaccggtaaaacgtacgggtttacgggtaacgaaccggttaaggttaaggaaaccgtaaacccggaccgggtaaacttaaacgttttacgttttaagtcgggttagtaaaccggttaaagttacgttttaccgggttcggttacggaacgtactacgtaacgtaagtggtagggtagtgggtcgtaccgtacggtacccgtacgggtacggggacctaacgggtaacacggttccggtacctaccgttccaccgtcgacgtccccgaccgaccgtacggccctacgtcccggttccctcccggctacccnccctacccataacgcgtacgtccg

SEQ ID NO: 43372 - DNA, 856 bp, Homo sapiens
  misc_feature: GYAE6OF01A99I0.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgtggtccggccgtgggggtccctgagctctcctgtgccatgtctgcgttctgtaattcatcctcaggctacgtagtggctagtgacacgtcgggtccgcccgacggccccgaggcgaaagggcgtaggaggttgggtggactagtttatactagtttgataggaagtaaattaaaaagtttaccgcgaacgtacgtccgtaggaacggtcctacgttacacctacgtcctaccgacggtaccgtacccctttacccgaaaccttacgtaaccgtcgttacggttacttaccgtaaccctaaacgtacggtaactacggttaggtacgtaacgtacgggttaacgaacggtaacccgtaacgggtaaccttaaacgtttacgtttaacggttcgtacgggtaaacgtaaacgggtttacgtttacggggttaccggttttacggaaccgttacgtaacgttaacggttaacgttaggggtaacgggttaacggttacggggttccggacccggttaccggtaccgtacccggggtaccggggtaacccgtaaccggggtaaaccgtaaccgggtttccgggtaaccttaccccgggttctaccccgtcgacccgttaccctacccgtaacccgggtaccgggcccgttaacccggttcccggtccccccgtttacccggcccgtacccctcccgtaacccacccggtaacggtccggacccgtacccggg

SEQ ID NO: 43373 - DNA, 923 bp, Homo sapiens
  misc_feature: GYAE6OF01ANSFS.31.14.B03.1.454.CMB.1.raw
  modified_base (187)..(187): a, c, t, g, unknown or other
  misc_feature (187)..(187): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggctgggggtccctgagactctcctgtgccatgtctgcttctgtaattcatcctnaggcactatggcatgtcacgtcgggtaccgccacgggccccaggacgaacgggctgggaggtgggtgtactagtttaatactaagtttgaagtaggaaacgtaaatttaaaaaagttttcggactacggtacctaccggtaaggaacgggtacctaagttaccaaccgtactccgtaccaagaaccgtaaccccttacaaaccgtgtaccgtacttagtaaccttacctaaccgtaaaatccggtaaactaaggttcgggttaacgtaaccgtaaggtttaacggaaagtaacccggtaaaccgggtaacttaaaccgttttagttaacggttcgtaacgggtaacggttaaacgttagttttcgggttaacgggttaccgtaacggtacttaaacgttaccgtaaaggtttagggtaacgggtaacgggtttacggggtaacggttcccggttaaaccggtacccggtaaacccgggggtcggggggtaaacccgtaaacgggaaccggtttaaacccggttcgggttaacccctaacccgggtttccctaccggttaaccctacccggggtaccccttacccccgggaaaaccggttaccccggggtaccccttaccggttaccccccggggttttaccccgtttaaccccccgggtccggtaaccccccttacccccggttaccccctaaacccgaaacccggggtccgtaacccccggtttaacccccgggg

SEQ ID NO: 43374 - DNA, 898 bp, Homo sapiens
  misc_feature: GYAE6OF01BIDR1.31.14.B03.1.454.CMB.1.raw
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtcctgagactctctgtgaccatgtctgcgtctgaattcatccngaggcactacgnggcagtcgacacgttcgggccnccgacggccccgaggacgtaagggcgtgggaggtcgggtgacttagtttaacgaacttaagttgaagtaggaaagtaaaattaaaaaacgttttccgaacgtaacgtaccgttaccggtaagggaaccgggtaccgttaacttaccaaccttacgttcccgtaaccggtaacggtaacccggtaacccctttaaccgaaaacccgtacgttacccgtacgttacggttaactacccgtaaccgtaaaacgttacgtaaaccgtaggttacgggtaacgaacgttaagggtttaaacgaaaaccggaacccggtaaaccgggtaacctttaaacgttttaaacggtttaagttacgggttaacgtaaacggttaaaacggtttacgttttacggggttaacgggttacgtaacggtacctaaagttacggtaaagtttgggtaaaggttagggttacgggtcggtaccgttacggtaacccgtacggggtacgggaaccgtaaacgggtaaccgtcggttacccggtaccgtacccgttaccgtaccctacggtaccccgtacccttaaccgggaaacccggtaacccgggttacccctacggttacccccggttacccttccccccgtacggtaaccccctacccgtacccgtaaagaccgtccgtcccggtacccggg

SEQ ID NO: 43375 - DNA, 831 bp, Homo sapiens
  misc_feature: GYAE6OF01CC0ZV.31.14.B03.1.454.CMB.1.raw
  modified_base (245)..(245): a, c, t, g, unknown or other
  misc_feature (245)..(245): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcggtggggagcgtggtccggccgtgggggtccctgagtacctctccgtgtcgcctagtcgtctgtcgtctagtaacttcacttccgcgaggtacctactagtcggacagtcgaccgtacggttcgggacccncggaccggtaccccgaggaccggaaagggtacgtgggtacgggttcgggtacggacttaaagttttactaacgttaagtttagtagtaaggtaaacgttaaaaactttaaaaaacgtttcgaacgtaacgtaccgtacggtacgggaacggtaccgtattacccacctactccgtaaccgtaacgaacccgttaaccccttaaccgaaaccgtaacgttaccgtacgttaacgttaacctaacctaaacgtaaaacgtacggtaaacgtagggttacggaacgtaacgttaacggttaacgaaacggtaccgtacgtaaacttaaatttagtagttgaacggtaagtaacgtttacgtttcgggttagtacgaacgataacgtacgtagtaggtaggtaaggttcggcgtacgtacggtacggtaccgggtacgggaccgaaggaccgtcggttacgccgttaccgtcctaccgtacacccgtccctaacccgaaccgggtaccgcccgttcccgtccccggtttacccgcccccgtacgacccccgttacccctacgacctaacccggccgtccgtaacccgggg

SEQ ID NO: 43376 - DNA, 744 bp, Homo sapiens
  misc_feature: GYAE6OF01C1B6O.31.14.B03.1.454.CMB.1.raw
  modified_base (122)..(122): a, c, t, g, unknown or other
  misc_feature (122)..(122): n is a, c, g, or t
  modified_base (147)..(147): a, c, t, g, unknown or other
  misc_feature (147)..(147): n is a, c, g, or t
  modified_base (688)..(688): a, c, t, g, unknown or other
  misc_feature (688)..(688): n is a, c, g, or t
  modified_base (718)..(718): a, c, t, g, unknown or other
  misc_feature (718)..(718): n is a, c, g, or t
tcagcagtagacgtcacgaccggtgctcgatttagtgtgagtagtttggggttaggggggagctacaacgaggcaggcaggggcagcaaggatggtgttgcagacccaggtccttcatttcncttgttgctctggatctcgtggtcnccgtacgggatattcgtgagtgacgtcctagtttccaagtcctccgtggtctgttcgtctcggtgggcgaggacggaccacatacaactcgactaacgtccaggaccaaggtacgttttcggttttacgtccggaacccctaataaactaacgtaacttacgttaggtaccgtttacgaaccagacgaaaggtaaacgtacggacacggtacccttaaccctaaagttccgtagttaaccgtttacgtcgggtacctttacgaacccgggacttaaccgggtcccgggtttaaccctaacggtactttcgaacggttcggacgtacggggttcggtacgttacggggaaaccctttgtaccaacgtccgtaccaactagtaccacggtaccgcgtacccgtaggtaccgacggtacgtaggtaaagcgttacgggacgtagttttacgttaagttccagtaccgtaactacgtaaactttacgttactttaccgtttcgttaccgttacgtacgttacgggacgtaaggcgtaagggtacncgtaagaaccgaacgtcgtgcgttaccganacgtactagttctacgtctcggtacc

SEQ ID NO: 43377 - DNA, 815 bp, Homo sapiens
  misc_feature: GYAE6OF01CLCYU.31.14.B03.1.454.CMB.1.raw
  modified_base (67)..(67): a, c, t, g, unknown or other
  misc_feature (67)..(67): n is a, c, g, or t
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
  modified_base (440)..(440): a, c, t, g, unknown or other
  misc_feature (440)..(440): n is a, c, g, or t
tcagcagtagacgtcacgaccggtgctcgatttagtgtgagtagtttgggctgagctgggttttccncgttgctcttttaagaggtgtccagtgtcaggtgcacctggtggaatcgtgggggagcgtggtccggccgtggggggtccctgaagcctctccgtgtcgccatgtctgcgtctagtaacttcgacttcccanacggacctaactagtcggctagtcgacctcggttccgggcccaccgaccggacccagggtacgaacgggcgtgggaggtcgggtgactaagttttanactaaagttgagtacgaataaattaaaaacgttcgactagtaccgtacgtacggacggtccgtaaccttaccactactccgtaaccgacgtaaccgttaccctaccaacctacgtaccgtacttacgtactaccctaacgtaanacgtaacgtacgttacggtacgtaacggtaggtaacgaacggaacgtaaccgtacgttaaactttcgttaagttacgtacgtaacgtaagtcgttttaggttcgggtaacgactaactacgtagtaaaggttcgaggggttacgttacggggtccgtaccgtaaccggtaccgtaccgggtcgggaaccgaaaccgggtaacctccgggttacgttcccacccggttaccctaccgaccggtacccgtaccccgacccgggtaaacccgacccggtacccgttacggttcccccggtaccccttttaccccggcccgttaacccccgtacccgtttacccgaacccgacggtccccggtaccggttaaccccggg

SEQ ID NO: 43378 - DNA, 828 bp, Homo sapiens
  misc_feature: GYAE6OF01BOZXH.31.14.B03.1.454.CMB.1.raw
  modified_base (178)..(178): a, c, t, g, unknown or other
  misc_feature (178)..(178): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtcgccatgtctgcgtntgaattcatcctcaggctaactagtggcagtggctacggtcggggtacccgcccgaccggacccccgagggaccgaagggggtaccgtagggtagggttggggtacggtacttaaattttaactaacgttaagtttggaagtaagggtaaagttaaaaatttaaaaaaacttttaccggactaacgtaccgtaccggtaggaacggggtacctattaccaaccactccctaccgaacggtacgtaaccccctaaccaaacctacgtaacgtcttacggtactaccctaactaaagtacgaacgtagtaggggtacctaaggtaacgtagaaacgaaccgtaacggtaacttaaacttatttagtaggtaaggtaacgtaaaggttacggtttacgggttacggtacggtactacgttaataacgtagtacgggttagggtaaggtaacgggtcgtacccgtacggtaaccggtaccgggtcgggaaaccggaacgggaacctgggtaccgtaaccgtcccgtacctacgtacgaccgtaccctaacccgaacccggtacgggtcccctacgggttccccgttcccccgtaccccgtacccggtacccctacccccggtacctaacccgaccgtaccgcccggtacccggg

SEQ ID NO: 43379 - DNA, 980 bp, Homo sapiens
  misc_feature: GYAE6OF01E3ADQ.31.14.B03.1.454.CMB.1.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctagtaattcatcctnaggcactatggcagtcgcacgtcgggtcccnccgacggccccgaggcgaagggctgggaggtggggtcgtcttaattttaacgtaacttaagtttgagtagggtaaagttaaaaactttaaaaaaagttttccgacgtaaccggtaaccgttaccggtagggtaaacggggaccccgtaagtttacccaaccctacttaccctaccgaacgtaacccgtaaccccctttaacccgaaaaccctaacgttaaccgtacttacgtaacttacctaaaccgtaaacttacggaaaactagtacgggttaacgtacgtaacggttaacggaaacggtaaccgaaaccgggtaacctttaaaacgttttaagttttaaggtttaacgggttaaccggtaaacggttaaaacggtttaccggtttttacggggtttacgggtttaacccggtaagtacccgttaagttaaccttaaagggttcgggttacggggtaaggttttacgggggtacggtacccggttaccggtaaccccggtcccgggggttaacgggggaacccggtaaaccggggtaaacccgttccgggttaccgggttacccctaccccggtttacccgttaccccttaacccggtaacccggcccccgttaaaccccgaaccccgggtaaccggggtaccccccctttagggttaccccgtttcccccccggtttaccccccgtacccggtcccccctaaccccccgttaccccgtaaccgtaacccggtaccggtaccccgtacccggggg

SEQ ID NO: 43380 - DNA, 720 bp, Homo sapiens
  misc_feature: GYAE6OF01ENQP7.31.14.B03.1.454.CMB.1.raw
  modified_base (295)..(295): a, c, t, g, unknown or other
  misc_feature (295)..(295): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcactcctcaggcactatggcatgcacgtcggtccgccacggcccaggacaagggacgtggagtgggtggctatttatactatttgagtaggaataaattaaaaatttacganagactaccggtgaacggcctattcaccatccaccgagacgtaccccttaccaaactatacgctagttactacctaccaaatcgaacgtagtaggtacgactaggttacgaagacgaacgtactaaatttagttagttgtagtaacgtaaagttcgtttaggttcgttacgagactaacgtataagttggtacggtagttaggggtcgccgtacggaccgtaccgggtacggggaccgtaagggtaaccctacgggttcggtacctacccggttcctacccgtacgacccgtaccccgtacccgtaacccggtaacccgggtccccgtaggttaccccggttccccccgtttccccccggttaccgggcccccttaacccccgttaccccgaacccgtaaacggcccccgtccgttaacccccggg

SEQ ID NO: 43381 - DNA, 853 bp, Homo sapiens
  misc_feature: GYAE6OF01BYZXW.31.14.B03.1.454.CMB.1.raw
  modified_base (191)..(191): a, c, t, g, unknown or other
  misc_feature (191)..(191): n is a, c, g, or t
  modified_base (828)..(828): a, c, t, g, unknown or other
  misc_feature (828)..(828): n is a, c, g, or t
tcagcagtagacgtcacgaccggtgctcgatttagtgtgagtagtttgggctgagcttgggttttcctcgttgcttctttttaagaggtgtccagtgtcaggtgcacctggtggaatcgtgggggaggcgtggtccggcgtgggggtcctgagactctctgtgccatgtctgcgtctagaattcatcctanagcacgtagtggcatgacctacgtcgggtcccgacccgacggccccgaaggtacggaacggggtacgtggggagggttggggtacgacttaagtttttaactaacgtaaagttttggaaagttaggaaaacgttaaaaacgttttaaaaaaacgttttccgaaccgttaacgtaccggttaccgggtaacgggaaaacgggtcccttaactttccgaaaccctcgttaccctaacccgaaggtaaccctaacccccttaaccaaaccgtaacgttaccggtacttacgttactaccctaaaccgtaaagtagaaaccgttaggttacgggtactaacgtaaggttaacggaaacgaccgtaaacgtaaactttaacttttaagttacgttggtaacgtaaacgtaaagtttccgtttacgggtttgggtaactagacttaacgtagttaggtagggttaggaacgggtttcgggacggtaccctacggacggtaacccgggtgggaaccggtaagggaacccttcgggtaccgttaccctacgttaccctcgccgtaccgccctaacccgaaccggacccggttcctagggttcccccgttacccgttaccccggcgaccccttaccccggtaaccncggtaaaacgtccctaccgtcccgg

SEQ ID NO: 43382 - DNA, 907 bp, Homo sapiens
  misc_feature: GYAE6OF01B6ULD.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtgcctatgtctgcgttctgaattcatcctcgaaggctactagtcggctagtcggcctacgtcggggtcccaccgacggcccccgagggcgtaaaggggtcctgggacggtggggtacggcttaagttttaacgtaacttaagtttgaacgtaggtaagttaaacgttaaaaaacgttttccgacgtaacggtaccgttacggtacggaaacgggtcctacgttacccgaaccgtacttccgtaaccaacggtaaccgtaaccccctttaccgaaacctacgtaccgtacttacggtaacttacctaaccgtaaagtacggtaaactagggttacggtacgaacgtacggttaacggaacggtaaccgtaaccgggtaacttaaactttacgtttagtttacggaacggtaacgttaaacggttacgttttacgggttacggttacgtaacgtactaacttaacggtacggtagggttaacgggtaaggttcggggtaccgtaccgtaaccggaaccggtcccggggtaagggacccgtaaacggggtaaccgtccggttaccgggttaccctacccggttaccgtacccgtaccgaccggtccccgttaaacccggaacccgggtaaccgggtcccgttacccggttacccggggtttcccccttacccccgggaacggttacccccctaaccccggttacccggttaaacccgaaccgggttccccgtacccggttaaccccgggg

SEQ ID NO: 43383 - DNA, 873 bp, Homo sapiens
  misc_feature: GYAE6OF01AJPS7.31.14.B03.1.454.CMB.1.raw
  modified_base (857)..(857): a, c, t, g, unknown or other
  misc_feature (857)..(857): n is a, c, g, or t
tcagcagtagacgtcacgaccggtgctcgatttagtgtgagtagtttgggctgagcgtgggttttcctcgttgcttcttttaagaggtgtccagtgtcaggtgcaccgtggtggaatcgtgggggaggtcgtggtccggtccgtggggggtccctggagtactctcctgtgcctatgtctggcgttctagtaattcactcctacgaggctaactgtgggacctatgaccgtccggtccggggtaccccgcccgaaccgggccccgacgggaccggaaaggggtccgttaggggaggttggggtcgtacttaagttttaataaacgttagtttaggaaggttagggtaaaaattaaacgtttaaaaaacgtttccggaacgtacggtaacccggttaccggttaacggggaaccgggtaccgtaccttacctacccgtaattcccgtaaccgtaacggtaaccccctaacccctttaacccggaaaccttccgtaacggtctttacgttaactacccgtaaactaaacgtcgtaaacgtacgtaagggtacttaacggtagtaacggaacgtaccgtaaacggtaacctttaatttaagttacgttacgaagtaacgttaagttacgttcggttaggtacgactagtacgtaacgttaagttcgggtaggttaggtaacgggtcggccgtaaccggaccggtaccgggtacgggtaaccggtaacggtaccgtcggtacccgtacccgttaccgttcccgacttccggaccacccggtaccaaccggtcccggtacttacccggtcccttaccccggtcccctacccggttacccctaccccgtacgaacccgtaccncccggtacccgtcggg

SEQ ID NO: 43384 - DNA, 695 bp, Homo sapiens
  misc_feature: GYAE6OF01BUB8L.31.14.B03.1.454.CMB.1.raw
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgacgtctgaattcatcctcaggcactagnggcatgcacgtcgggtccncgacggcccgaggcaagggctggaggtgggtgctagtttacactagtttgataggaactaagtaaaaatttcgacaacgtacctacggtaggtaacggacgtacttcactactccgtacacgtaccgacccgttaccaactagtaccgtctagtactacgtaccaaagtcaacgtagtacggtactaacgtaggttagaacggtactaacggtaccttaattgttacgttagacgtaagtaagttactttcgggttagtacgagtactatacgagttgggtagtaggttagggtcncgtaccgactacggtcggggacctaagggtaccgtacgttcggtacctaacccgtcctaccgtacggtacctaccccgttacgaacccggtaccggtcccctaacgggttcccgttcccctcccccgggtataccccccgtaaccctaccggttaacccaacgtcggtaccctaccccggg

SEQ ID NO: 43385 - DNA, 974 bp, Homo sapiens
  misc_feature: GYAE6OF01A73GL.31.14.B03.1.454.CMB.1.raw
  modified_base (117)..(117): a, c, t, g, unknown or other
  misc_feature (117)..(117): n is a, c, g, or t
  modified_base (123)..(123): a, c, t, g, unknown or other
  misc_feature (123)..(123): n is a, c, g, or t
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgcttcttttaagaggtgtccagtgtcaggtgcactggtggaatcgngggggngcgtggtccggcgtgggggtcctgagactctcctggtcnccatgtctgcgttntgtaacttcactcctacgaggcacttagtggacagtcgccnccggttcggggcccgacccgaacgggcccccgaggggaccgaaagggtccggtgggtacgggtgggtaggtacttaatttaacaagttaagtttgagtaaggtaaacgttaaaattttaaaaaacgttcgacgtaaccgtaccggttaacggtacggaaacggggtccccttacgttaccgaacctacgttaccccgtaccggtaacccggtaaccttaacccccgttaaccctaaaaccacggttaaccttaccgtcgtaacccttacttaaccgaaagtacgtaaacgtaccgttggtaacacggttaaggtaaagaacgtaacccgtaacggtacttaaaagtttacgtaggttaacggtaacgtaacggttaaggttacgtttacggtttacggttaccgggattaactacggttaaacgtaaacgggttcgggtttaaggggtaaacccgggttaagggtccggttaaccgggtacccggttaaaccgggtacccggggtacgggtaaacccgggttaaccgggaaccgtttacccgggtacgggttacccccctaccggttttcccgaccccgttaccggtaaccccgaccccgttaccccggggtaaaacccggtaacccccgggttaccccgttaccccgggtttcccccgggttacccccccttacccccggttccccgggtaacccccttaccccgggttaaccccgtaaaccccgaccggtaacccgaccccgggttacccccggg

SEQ ID NO: 43386 - DNA, 833 bp, Homo sapiens
  misc_feature: GYAE6OF01A12PG.31.14.B03.1.454.CMB.1.raw
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgctctgaattcatcctcgaggcactagtggacatcgactacgtcgggtccnccgacggccccgaggacgaagggctggaggtgggtcgactatttactactagtttagagtaggaagttaaaattaaaaacgtttcgacaagtaccgtaccggtaggaacgggtacctataccgaactactacctaccgaacggtacctaacccctaccgaaacctagtaccgtcttacgtactacctaacctaaatacggtaacctagttacggtacgtaacgtaaggttaacgaacgtaccgtaacggtaactttaaacgtttaagtttacgttaggtaacgtaacggttaaggtttacgtttagggtttaccggttacgaacgtaactattaacgtaagttcgggtaaggtacggtaggggtacgtccgtaaccgggccgtaacccggggtgggaaccgtaacgggaccgtaccgggtaccggttacccgtcccgttaccgttaccgacccggtacccgtaccccggtaaccccgaaacccggggtaacccgggtaccccttacccgggttaccccgttccccccgttaccccggtacccggtaccccccttaacccccgttaccccgaaacccgtaaccggaccccgttaaccccggttaccccgggg

SEQ ID NO: 43387 - DNA, 830 bp, Homo sapiens
  misc_feature: GYAE6OF01BJ58H.31.14.B03.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtcctgagctctcctgtgcatgtctgcgtctagattcactcctgaggctacttagnggcagtcgcctacggtcgggtcccnccgaccggccccgagggccgaagggacctgggacgggttgggtcgtacttaatttaactaacgtagtttggaagtaggtaaaagttaaaacttaaaaaaagttttccgaactaaccggtaccgttaccggtaggaaccggggtccctaacttaccgaacctacgttacccgtaccgaacggtaacccgtaccccgttaccaaccgtacgtaccgtcgttacgtactaccgtaacaagtacgaacgtagttacggtactaacgtacggttaagaacgacgtaaccgtacttaaacgtttacgttagttacggtaacgtaacgtaacgtttacgtttcgggtttacgtacggtaacacgttacgtaactaaggttgtaggtacggttacgggtcgtacccgtacgtaccggtacccgggtacggtaccgaacgggtaccgtaccggttacggtaccctaccccgttcgtaccgtaccgcccggtaccctacccggaaccgtaacccgggtccttaacccggttccccggttcccccgttcccccggtacggtacccccctaccccggttacccgaacccggaaggtacccccgtccggttaaccccggg

SEQ ID NO: 43388 - DNA, 908 bp, Homo sapiens
  misc_feature: GYAE6OF01C9BPV.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatcgtctgcgtctagtaacttcacttccctcgaggcaacttagtgggcagtcgaccgtacgtcggggtcccgccgaacggcccccgaggacggtaaagggcgtgggaggtgggtggtactagtttaacaagttaagtttaggaagtaggtaaagtaaaagtttaaaaaaacgttttacgacgtaacggtaccgtaccggtaaggtaacgggtaccgtaacttaccaacctactacctaccgaacggaaccgtaacccctttaacccaaaacccgtacttaaccggtaccttacggttaacctacccgtaaaacgtaaacttaacggtaaaccgtaacggtaggtaccgtaaaggttaaacggttaacggaaaccgtaaccgggtaaaccggttaaacccttaaaacgtttttacgtttaaaggtttcgggttaacgggtaaacccggttaaaagtttacgggttttaccgggtttacggttaacgggtacgttaaccgttacggttaaacgtaaacgtttgggtaacgggtaaggttacggggtaccggtacgttacccgtaacggtacccgggttaacggggaaccgtaacgggtaacccttacgggttaccggtaccttaaccccggttcctcccgtaaccgtccgtaccccgacccggtaaccgaccggttacccgtacgtccccgttccctacccccgtgacccctacccctacgaacgtacgcctcccggtaccggg

SEQ ID NO: 43389 - DNA, 832 bp, Homo sapiens
  misc_feature: GYAE6OF01CAHF0.31.14.B03.1.454.CMB.1.raw
  modified_base (191)..(191): a, c, t, g, unknown or other
  misc_feature (191)..(191): n is a, c, g, or t
  modified_base (478)..(478): a, c, t, g, unknown or other
  misc_feature (478)..(478): n is a, c, g, or t
tcagcagtagacgtcacgaccggtgctcgatttagtgtgagtagtttgggctgagctgggttttcctcgttgcttcttttaagaggtgtccagtgtcaggtgcacctggtggaatcgtggggagcgtggtccggccgtgggggtccctagagactctcctgtgccatgtctgcgtctgtaattcacttccncgaggctaactgtcggactagtcgactacggttcgggtcccaccgacggaccccgaagggtaccggaaagggtcgtagggtaggtcgggggtctacttaaagtttagaacttaagttttcggaagtaaggtaaagttaaaatttaaaaaacgtttccgacgtaacggtaccgtacggtaggacgggtaccttaacttaccgacctaacgttccaaccgaacggtacccttacccttaacaacttacgtacggtcttactacctaacctaacgtaaaagcgtaaacgngttacggtagaacgtaggttaacgaacgtacgaacgttacgttaactttagtacggttacgaacgtaacgttaagttcgttttacggtaggtacgaactcgttaacgtaacgtaaggtggttaagggttaacggtcgggtaccgtaccgtaccgggtaaccgtaccggggtcgggtaaccgtaacgggaaccttaggttcccggttaacccgtaccgttccgtacccgttacggtaccctacccggtaaccccgacggtaaaccccgggtccttaacccggttcccggtttacccgtaccccgtaaccgccccttaacccgtccgtaacgacccgttcgacccggttacccggg

SEQ ID NO: 43390 - DNA, 728 bp, Homo sapiens
  misc_feature: GYAE6OF01C8UFR.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtccgccacgggcccccagggccaaaggggactgggaggtgggtggctatttagactaattttggataggaagaaatttaaaaaaacgtttttaccgactaagtacgtaccggtaggaaacgggccgtaatttccgaaccatcctaccagaaccgtaccccttaccaaccaataccgctacgtaactcctaccaaatggaaacctagtagggtcaacgtagttacgaagacgaacggactaaacgttattacgttgtagacgtaagtactttcggttaggtacgacgtactaattaccaaggttcgtagggtaagttaggggtcgaccgttacggaaccgtaccgggtcggggaaccgtaacggggaacgtaccgttgggtacccaacccggtttccacccgttacaaccggtcccctaaacccaccggtaaacccggtccctaaccgttcccgggttccccttcccccgtaggacccctacccccttaccgaccaaacgggccgtacccgtacccgg

SEQ ID NO: 43391 - DNA, 912 bp, Homo sapiens
  misc_feature: GYAE6OF01C3C4Z.31.14.B03.1.454.CMB.1.raw
  modified_base (617)..(617): a, c, t, g, unknown or other
  misc_feature (617)..(617): n is a, c, g, or t
  modified_base (732)..(732): a, c, t, g, unknown or other
  misc_feature (732)..(732): n is a, c, g, or t
tcagcagtagacgtcacgaccggtgctcgatttagtgtgagtagtttgggctgagcttgggttttcctcgttgcttcttttaagaggtgtccagtgtcaggtgcaccgtggtggaatcgtgggggagcgtgggtccggccggtggggggtcctgagactctctgtcgccatcgtctcgtcgttctagtaacttccaacttcccgtacgacggcctaacgttagtcggctagtcgacgtaccggttccggggcccgaccggacccggacccgaagggaacggtaaacgggtcgtaggggaggtgggtcggtaacttagtttaataacgttaatttaggagtaagggtaaattaaaaacgttttaaaaaagtttccgaacgtaacgttaccgtaccgggtaaggtaaccggaccttaactaccgaacctacgtccgtaaccgaaccgtaacccgtaaccccttaaccgaaccttaacgtacctcgtttaacgtacctacctaaaccgaaaggttacaacgtagttacggtacaaacggtaagtacggaaacgtactaaccgttaattaaacgttttataagtaacggtaaacgttaagttcgtttaggttacgtacganacttaaactacgtaaggttaggtagggtaaccggttacgggcggtacccacggtaaacccggccggggttaacgggaaccggtagggtaaccttaccggggtaccgttaaccccnccgggtttaccctaccctacgggtaccccgtaacccgtaccccgaaaccggggtaacccttacccgccccgggtttacccccgtttccccccggttccccgggaccccttacccccggttaccccgttaaacccgtaacccgggtaaacgtccccggtaccggttccccggtaacggggg

SEQ ID NO: 43392 - DNA, 792 bp, Homo sapiens
  misc_feature: GYAE6OF01AJA5H.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtcgggtcccgccgacggccccgagggcgaagggcgtgggaggtgggtgactatttatactaagtttgaagtggaagtaaattaaaaaactttcgacgtaacgtaccgtccggtaggaaccgggtccgtaacttacccaacctactccgtacccgaacgtaacccgtaaccccctttaacccaaacccgtacgtaccggtaccttacggtaaccttacctaaaccgtaaagtacgtaaacgtacggttacggtacgtaacgtaaggttacgaaacgtaccgtaaccgtaacttaacgtttattagttaggtacggtaacgttaaagttcgtttcgggttacggtacgacgtacgtacgttacgtaaggttgggtaggtagggttacgggcgtaccggtaccgacggtaccgggtacgggaccgtaacgggtacctacgttccggtaccctaccgttccctaccgtaccgtaccgtacccgtacccggaaccggacccggtcccgtaccggttccccggttcccccgtccccggttacccgacccctaccccgtaccgaaccgtaacggtccgtccggtaccccggg

SEQ ID NO: 43393 - DNA, 932 bp, Homo sapiens
  misc_feature: GYAE6OF01B890Y.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtggggggtccctgagactctcctgtgccatgtctgcgtctagtaattcactcctcacggctactagtggctatcgcctacgtcgggtcccgccgacggcccccgaggaccgaaggggtcgtggggagggttggggtcggtacttaagtttaataactttaagttagaaggtaagggtaaaattaaaaaaacttttaaaaacgtttaccgaacgtaacgtaacccggttacggaacgggaaccggtactacctaccgactaccttccgaccgaaccgttaccccgtaaccccgttaacccaacctacgttaccgtcgttaactacctaacccaaactaacgtacgaaacgtagtacggaacgtacgtaaggtaacgaacgtaaccgtaacgttaaacttaaggtttatttacggttagtaaccgtaaagttaggtttaccggttttcggtaggtaacgacgttactaacgttaggtagggtggtaacgggtttaaggggcccgggttacgtacccggtaacccggtaacggggttaccccggggtacggggtaaaccggggtaaaacggttacccgtaccggggttttaccccggtaacccctttacccccggtttaccctccccgggtaaccgtaaccccccgggttccccgtaaaccccccggaaaacgggggtttccccccgtacccgggtttccccgggttacccccctttttcccccgggacccccgacccgtcccccctaaaccccccgtttaaccgaggaaacccggtcccctccccgggttaacgggg

SEQ ID NO: 43394 - DNA, 701 bp, Homo sapiens
  misc_feature: GYAE6OF01DTGVX.31.14.B03.1.454.CMB.1.raw
  modified_base (87)..(87): a, c, t, g, unknown or other
  misc_feature (87)..(87): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
tcagcagtagacgtcacgaccggtgctcgatttagtgtgagtagtttgggctgagctgggtttcctcgttggctcttttaagaggtntcagtgtcaggtgcacctggtggaatcgtgggggagcgtggtccggcctggggggtccctgagcctctcctgtgccatgtctgcgtctagaattcattccncaggcattnggcatgccacgttcgggacccncgaccggccccaggacgaagggtcgtggaggtgggcgactatttanactaatttggatagggaataaattaaaaatttcganacacgtcgagaagggcctatcaccatcgtaccgagaccgtaccctaccaacgtactacgtctntactccaacctaaagtcgaaactgtagagactaaggtagaagacgacggtactaacttatttagtgacgtaagtaatacgttcgggttacgttgagtactagtaactagtgtacgggtaggtacggtcgtaccgtaccgaaccggtacgggtaccgggacgtaacggtacctaacgggttccggtacccgttacccggtcctacccggtactaccccgtacccacccggtacccggaaaccgggttccccctagttcccccgggtttcccctaccccggtcccggtaccccttaccccggtaccctaccgaaacggttcccgtaacccgtccccggg

SEQ ID NO: 43395 - DNA, 927 bp, Homo sapiens
  misc_feature: GYAE6OF01EDNNQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtgggggtccctgagactctcctgtgccatgtctgcgtctagaactttcactcctacgacggtcaacttagtcggactactggcctacggttccggggtccccgaccgaaccgggccccccgaaggggacccgaaagggggtaccgtggggaagggttcgggggtcggtaccttaaagtttttaactaaacttaagttttaggaagttaagggtaaagttaaaaattttaaaaaaaacgttttcggaacctaacggtaaccgttacccgggtaagggaaacggggtaccccgtttaactttaccccaacccttacgtttacccaacccggtaacggtaaccctaacccccttaacccgaaaacctacgttaaccgtactttacgtaacttaccgtaaaccaaaagttacgaaacgtagttacggggtataaacgacgggttaaagaacgaacgtaaccggtacttaaactttagtttagttgggaacgtaacggttaaaggttcgtttacggggtttaggttacgaacgtactaattacgtaaggttgggttaagggaggttagggtcgtaccgtacgaaccgtccgggaggggaaccgaacgggaactaccgggtcgttacctacccgttctaccgtaccaccggtacccctaacccggaccggtaaacccgggtccccctacggtttaccccccggttcccccgtttacccccccgggtaccgtaccccccgttaaaccccccgttaacccctaacccggaacggtcccggttccccgtaaccccgggg

SEQ ID NO: 43396 - DNA, 938 bp, Homo sapiens
  misc_feature: GYAE6OF01A46IR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcactggtggaatcgtgggggagcgtggtccggccgtggggggtccctgagactctcctgtgccatgtctgcgtctgaattcatcctcaggcactatggcagtgccacgtcgggtcccgccacgggacccccagggtaccgaagggtcctgggtaggtgggggttggactattttaatacttaagttttgaagtaggtaaagtaaaagtttaaaaaacgttttacgacgtaacgtaacgttccggtaacggaacgggtccgtaacttaccgaaccctaacttcccgtaccgaacggtaaccgtaacccccgtttaacccaaacccacgttaacccggtacttaacggttaacttaccccgtaaacctaaaacgttaacggaaaaccgtaacggtttacggggtaacgtaaacccggttaggtttaaacggaaacggtaaaccccggtacgggtaaacccttaaaaaccgttttattttaacggttaaggttaccggaaaggtaaacggtttaaccggttttcgggtttacgggttaccgtaacggtactaacttaccgttaaaggttgggttagggaacggttacgggttggtacccgttaacggtaaccgtaccggggtcggggttaaaccccggaagggtaacccgtaacgggttaccggtccccgttacccgttaaccgttccccgttaacggccccggtacccccttaaaccggacccccggtaaccgggttcccctaaccggtttcccccggtcccccgtttacccccggtccgtacccccgtaccccgtacccgtaacccgaacggtaacccgtccccgttaacccccgggg

SEQ ID NO: 43397 - DNA, 1021 bp, Homo sapiens
  misc_feature: GYAE6OF01CXOMJ.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtaggaatcgtggggaggcgtggtccggccgtgggggtccctgagactctcctgtcgccatgtctgcgtctagtaacttcactcccgtgacggactactagtggctaagtcggaccgtaaccggtccggggtaccccgacccgaaccgggaccccccgaagggtaccggaaacggggtaccgttaggggagggttcggggtacggtaccttaaagttttaacgtaaaccgttaaagttttaggaacggttaagggtaaaagttaaaaaagttttaaaaaaaccgttttaccggaaccgtaacggtacccgttaaccgggtaagggaaaccggggtaccctaacttaccaaccgtacgtaccctaccgaacgtaaccccgtaccccttaaccaacctacgtaccgtacttacgtaacctacctaacctaaagtcgaaacgtagtaggtaacgtacgtaacggttaagaacgtaaaccgtacggtaaactttaaacgttttagttaacgttaggtaacgtaaacggtaaacgtttcggttttaacgggtttacgggtaacgaacgttacgtaaacgttaaaccgtaaggttacgggttaaacgggttagggtttaaccgggggtccggttaaccccggttaccggaaccccgggttaaccggggtaccgggggtaaaacccgtaaccggggtaaacccttccggggttaccggttaaccccgttacccggtttaccccgtcccggtaacccggttaaccccgtacccccgtaaaccccggtaacccgggtacccgggtaaccccgttcccgggttacccccgggtttccccccgttcccccgtaacccgggtaccccccttaaccccggtaacccgtaaccccggaaacgtcccggtacccccggttaaacccgggg

SEQ ID NO: 43398 - DNA, 851 bp, Homo sapiens
  misc_feature: GYAE6OF01D35NH.31.14.B03.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
tcagcagtagacgtcacgaccggtgctcgatttagtgtgagtagtttgggctgagcttgggttttcctcgttgctcttttaagaggtgtccagtgtcaggtgcacctgggtggaatcgtgggggagcggtggtccggccgtggggggtccctgagactctcctgtgccatgtctgcgtntagtaattcatcctgaggtcactagtcggctagtgacctacggtcgggtcccnccgaacggcccaggcgaaggggacgtgggaggtgggtacgacttaagttttaanaacgttaagtttgaacgtaggtaaataaaactttaaaaagtttcgacgacgtaacttccggtaaggaacgggaccgtaattccgaactacgtccgtaccgaacggtaccgtacccttaccaaaccgtacgtaccgcgttacgtaactacctaactaaagtacgaaactagtaggtacgtaacgtaggttaacgaaccgtaacgtaccggtaacttaagtttaacttaggttacggtaacggtaacgttaaaggtttcggttttacggtacggtttacgaacggttactaacgttaacgtaaaggtttagggggtacgttaaagggttcgggtaccggtaccgtaacccgggtacccggttaaccgggggtaacggggaccccgtaaaggggaccctacggggttacccgtacccgtaccgttcccgttaccgtaccggtacccgtacccgtaccccgaacgggtaacccggtcccgttacccgtttcccggtcccccctttaccccggccgacccccgttaacccctacccggtaaggaacccgttcgacccccgttaccggggg

SEQ ID NO: 43399 - DNA, 746 bp, Homo sapiens
  misc_feature: GYAE6OF01ATTSR.31.14.B03.1.454.CMB.1.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatcgtgggggagcgtggtccggcctggggggtccctggagactctcctgtgcctatgtctgcgtctgaattcatcctcaggcactagtggcatcgcgtacgtcgggtccgcccaggtccccaggcgaacgggtctgggagtcgggtacnctatttanactatttgatcggataataaaattcgcacgctcgagacggctagtcacatcctacgacgactacccgtaccaacgtacgtacgtctacgtactactacctaagtacgaatagtggtacaacgtaggtaacaacgtaacgacggtactaaactttcgttaagtgtacgtaacgtaagttacgtttcggtacggttacgaacgtacgtataaccgtaaggtaggtacgggtaagtcggggtacgtccgtaccggaacgtcccgggtaggggcccgtaaacgggtaccttacgggtaccggttacccgaacccgggtttcctacccgtaccgtaaccggtccccttaccccggaaacggtaccccggtccccgttaggttacccccggttccccgttccccccggtaaggttcccccccgttaaacccccgtacccggttaacctaaaccgggtcccgttccccggttaaaccccgggg

SEQ ID NO: 43400 - DNA, 749 bp, Homo sapiens
  misc_feature: GYAE6OF01BFZLM.31.14.B03.1.454.CMB.1.raw
  modified_base (176)..(176): a, c, t, g, unknown or other
  misc_feature (176)..(176): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (734)..(734): a, c, t, g, unknown or other
  misc_feature (734)..(734): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtcgccatgtctgcgtntgtaattcatcctcaggcactatggcagtgcacggtcgggtcccgccacgggccccgaggacgaagggtctggaggtgggtggactagtttataacgtatttgagtaggtaagtaattaaaaagtttccganaacgtactcgtagagggcctatccacatcgtccagaccgtaaccctcaactacgtactcgtgtacttccaactaaatcgaaacagttcggtanaccggtagttacgaagaacccgtacgacgttaattaacttacgttagtacgtaacggtaaagttccgttttagggttcggtaacgtacgtgttaacgttaaccgttaaaggttcgggttaaagggtaggtaacggggggtttacctaccgggtttaacccgaaccgggttaccgtaacggggggacccgtaaacgggtaaccgtacgggtttaccgggtaccccgttccgtacccgtttaccgccggttaacccacgtaccccgaaccgggacccgttcccgaacgttccccgttaccccgtccctacggcccctacccgaccttaccgaacnccggcttacccgggg

SEQ ID NO: 43401 - DNA, 911 bp, Homo sapiens
  misc_feature: GYAE6OF01DNXEK.31.14.B03.1.454.CMB.1.raw
  modified_base (718)..(718): a, c, t, g, unknown or other
  misc_feature (718)..(718): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggaggcgtggtccggcgtgggggtccctgagactctcctgtgccatgtctgcgtctagtaattcacttccctcgacggacaacgttagtcgggactaagttcggaccgtaccggttccgggggtcccccacccggaacccggggacccccccgaaaggggtaacccggaaagggggtaccgttaggggtaggggttcgggggtacgggtactttaacgtttttaaactaaaccgttaaagtttttaggaacggttaaggggtaaaagtttaaaaaaacgtttttaaaaaaaaaaccgtttttcccggaacgtaaaccggttaacccggttaccccgggttaaggggtaaacccgggggtaccccgttaactttaaccccgaaccccttaacgttaccccgtacccgaaacggtaaccccgtaaccccctttaacccgaaacccgtacgtaacccgtacgtttacgtaacttacccttaaaccgaaagttaccgaaactagggttaggtacgtaacgtaggttaaacggaacgtaaccgacggtaacttaaagtttatttagtacgtacggaagttaaagttcgtttacggttacggtanacgtataacgtacgtaggttggtagggtacggtacgggtcaccgttaacggaccgtacggggtcgggaacgtaacggtaccgtagtccgtaccgttaccctcgtcctacgacccgtcccaaccggaccgaccggtccctcgttcccggttccctccccgcgccctaccctacacgaactccgtcccgtacggg

SEQ ID NO: 43402 - DNA, 809 bp, Homo sapiens
  misc_feature: GYAE6OF01AE5OI.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgtaattcatcctcaggcactagtcggcagtgcctacgtcgggtcccgccgacggcccccgagggaccgaaacgggcgtgggaggtgggtcgactaattttagtaactaagtttggaagtaggtaaagtaaatttaaaaaactttcgacgagtaccgtaccggtaggaacgggtcctactaccaccgtactcctaccgaacgtaaccgtaccccttaaccaaccgtacgtaccgtacttagtacttacctaacctaaagtacgtaaactggttaggtacaacgtacgttagaacgtaaccgtaccgtaacttaaacgtttaagttacgttagtaacgtaacggttaaattcggttttacgggttaggttaccgagtacctaagtacgtaagtgggtaagtacgggtcgggtcggtaccgtcggtaaccggtaccgggtacgggaaccgtaacgggtacctacggttccggtaccctaccgttacccgtaccaccggtacccgtacccgtaccccggaaccgtacccgggtcccgttaccggttccccgttaacccccgttcccccggtaccggtacccccctaaccccgttccccgtaacccggaaccggtccccgtcccggttacccccggg

SEQ ID NO: 43403 - DNA, 927 bp, Homo sapiens
  misc_feature: GYAE6OF01B5ATI.31.14.B03.1.454.CMB.1.raw
  modified_base (890)..(890): a, c, t, g, unknown or other
  misc_feature (890)..(890): n is a, c, g, or t
tcagcagtagacgtcacgaccggtgctcgatttagtgtgagtagtttgggctgagcttgggttttcctcgttgcttcttttaagaggtgtccagtgtcgaggtgctaccgtgggtaggaatcggtgggggaggcggttcgggtcccggccgggttcggggggtccctaggacgtaccttctccgtgtcgccatgtcgtgtacgtctagtattccacttcctacgacggcctaacgtagtggcctagtcggacctacgggtccggtccgaccgaccggccccgaggacggtacgggtacgtgggaggtcgggtatacgttaagtttagtaacgttagttgtaagtaaggtaaattaaaacgtttaaaacgttcgactacgtacgtacggtaacggacggtactacgtaccgacctactacccgacaccggtaccctaccctaaccgactacgtacgtacttagtacctactaacaagtactacgtagtaggaacgtagtaggaacgaacgacgtacgtaaacttagtttattacgggtacgtaacgtaaacggttacgtttacggtttaccggtaacgggtaccgaagttaacccgtaaggtaaccgttaaggttacggggttacggttaagggttaccggtaccgtaccggtaaacggcccgggtttaacccggggaacgggtaaccgtaaaccggggttaaccgttaccggttaccccgggtaccgttaaccccgtttcccggaacctacccggtacccgtaaccccggtaaacccggaaaccccggttacccgggccccgtttaaccccggttaccccgggttttaccccccctaccccccgggtaaccccgtttacccctaaacccccgggttcccccggttaaaanaaacccccggttcgggttaccccccgttaccgggggg

SEQ ID NO: 43404 - DNA, 810 bp, Homo sapiens
  misc_feature: GYAE6OF01CEL01.31.14.B03.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggccggcgtgggggtccctgagactctcctgtgcctatgtctgcgtctgaaattcatccctgaggctaacttagnggctatcgactacgtcgggacccncgaccggacccgagggactaaaggggctaggggtggtgggtacgtacttaaagttttanaacgtaattttggaagtaaggtaaacgtaaaaatttaaaaaaacgtttcgacgaacgtaccgtaccggtaaggaaccgggtcctaatttccgaacctaatccgtaccgaaagtacccgtaaccccttaccaaaaccgtagttaaccgtcgttaacgttaactacccggtaaacaaaacgttgaaaaccgtgttagggaagtaaccgtaaggttaaacgaacgtaacgaacggtaacttaactttaagttacgtaggaacgtaacggtaaagttcgtttcgggtttagtacgtacgtataacccgtaataggtcggtaagtacggttagggccacgtaccgaaccgtacgggtacgggaccgaacggtacgtaaccgtcggtaacccgtaccgttaacgtccctaacggtaccctcccgtaaacccgaaacccgggtaaccgtcccgttacgttccccggtccctttacccccggcttaacccccgtaccctaccctaaccggaacgtaccgtcccgttaaccggg

SEQ ID NO: 43405 - DNA, 875 bp, Homo sapiens
  misc_feature: GYAE6OF01CG195.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcgtggggggtcctgagtacctctccgtgtcgccattgtcgtcgtcgtctagtaactttcacttcccgtacgacggcctaacgttagtcggacactcggacctacgggttcccggggacccgaccgacccgggtacccccggaagggtacccgggtaaagggtaccggttaggggaggggtttcgggggtcgtacctttaaagttttaaacctaacgttaagttttaggaaaggttaaaggtaaaacgttaaaaagtttaaaaaaacgtttccggaacgttaacggtaacccgttacgggtaacggggaaccggtacgttaaccttaaccaccgtaactaccgtacccggtaacggtaacccttaccccttaaccggaaactaccgttacgtacttacgtaaccttacgtaaactaagtaaccgagtagtcgtaacaacgtggtaacgaataccgagttaacttattagttatcggacgaacgtacgttcgttcgtagtagagtactggtaactaggttcggaaggttcgacggggtcctacgtaccggacgggtacgggtacggaacggtaacggtacctaccgggtcgtacccgtaacgtccgtccgaacctcccgtaaccggtaccccgaaaggttcccgggtaccccctttaacccggttccccggttacccccgtaccggcccccgtaaccccttcccggtaaacccaggttaaccccggcgttaccccgggaccggg

SEQ ID NO: 43406 - DNA, 1200 bp, Homo sapiens
  misc_feature: GYAE6OF01EIYM9.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtgccatgtctgccgtctagtaacttcactccctgaggtaccaacttagtcggacctaagtcggacctaccggtcggggtcccacccgaaccgggacccccgaagggaaccgtaaagggggtacgtaggggtacgggttacgggggttacgaaccgtttaaagttttttaaacgaaaccgtttaaaagttttttcggggaagtttaaagggggtaaaaacggtttaaaaaaacgttttaaaaaaaaaaacgtttttttaaccgggaacctaaaaccgggttaacccgttaacccccggggtttaaaggggaaaacccggggttaccccggtttaaaacgtttaccccgaaaacccttaaccgttacccgttaaaccccgtaaaaccggggttaaaccccttaaccccccgtttaaacccctaaaaaccccgttaaacgtttaaacccggtaccgttttaacggttttaaaaccctaacccgttaaacccgttaaaaaactaaccggttaaaacgtaaacgggttttacggggtaaactaaacggttaaacgggttaaacggtaaaaccggtaacgtaaaacccccggggtaacttttaaaaaccgttttaaggttttaaaccgtttaagggggttaaccggtaaaaccgggttaaaaaccggtttaacgggtttttaccgggttttaacgggtttaacccggtaaaggttaaacccgttaaacgtttaaacccggtaaaagggtttaccgggttaaacggggttaaaggggtttaccgggaacccggggtttaacccgtaaccccggggttaaaaccccggttacccggggtaacgggggggttaaacccccggaaaacgggggttaaacccctaacccggggtttaaccgggaaaccccgtttacccccgttaaccgtttccccccgtaaccggaaacccgggtttcccccttaaaacccccggaaacccggttaaaacccccgggtacccccgtttaaacccggggtttcccccccggttaaccccccgtttccccccc

SEQ ID NO: 43407 - DNA, 837 bp, Homo sapiens
  misc_feature: GYAE6OF01BP327.31.14.B03.1.454.CMB.1.raw
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (263)..(263): a, c, t, g, unknown or other
  misc_feature (263)..(263): n is a, c, g, or t
  modified_base (681)..(681): a, c, t, g, unknown or other
  misc_feature (681)..(681): n is a, c, g, or t
tcagcagtagacgtcacgaccggtgctcgatttagtgtgagtagtttgggacgtgagctgggtttcctcgttgctcttttaagaggtgtccagtgtcaggtcgcactcggtggaatcgtggggagcgtggtccggccgtcgggggtcctgagactctctgtcgccatgtcngcgtctgactnagtcctnaggcactatcggacagtgacacggtcgggccgacgacggcccgaggacgaaggacgtaggtaggttgggaccgnttaatttaactaagtaagtttagaagtaggtaaataaaattaaaaaacgtttcgacgaagtacctacggtacggaagggacctaacgttcaacacttaccgaccgaacgtacctacctaacccgtaacaacgttacgtactagtaacttaccgaacctaaaacgtacgaaacgaaggttcggtaacaacggtaaaggttacgaaaaccggtaaccggaaaccgttaaaaccgttaaaatttagttttaaaccggtacgttaacggtaaaacggtttaaacggttaaccggtttacgggtttacgggtaaacgtaaacggtaacctaagtaaccgtaaaggttagggttaggtaaaacgggtgggttccggtaccgtacgggtaacccgtcgggtacgggaaacctaagggtaacccgngttttaacccgccgtaaccggttcctacgtaaccgtaccgtaaccgtacccgaaaacggtccgtaacccgttcccggttacccggttcccctaacccccggttaccgtaaccccgtaccctacccgttaaacctaaccggcgtcccgttacccggg

SEQ ID NO: 43408 - DNA, 819 bp, Homo sapiens
  misc_feature: GYAE6OF01AOGL0.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtcgccaccgtggtggaattcggtggggggaggcgttgggtccggccggtcggggggtccctggacgactctctgtgccatgtctaggcgtcgtagtaacttcatcccgtagaggtcaccttaggtggacctatcgaccgtacggtccggggtaccccgccgaaccggccccgaagggaccgtaagggtcgtgggtacggtgggtcgtacgtaactttaataccgttaagtttggaacgtaggtaagttaaaaattaaaacgttcgactacgtaccgtcggtaggaccggtactactaccaccgtacctacgtacccaggtaaccctacccctaccaatacgtctactcgtaacttaccacaagtacagcgtcggagtacgtaggtaacacgacggttaactacgttaaacgtttattaggtccggtaacggaagttaacggttcggtttacggtagttacgacgtactacgtagtaggtgtaggtaaggtcgtcggtacgtacggtaccggtacggacggaaccggtacgtacccgtacgttcccggtaccgttacccgttcctcccgttacggaccccgttaccgttaccccggaaaacgggttccccccgtaaccgtttcccgggtacccccgtttccccggttcccccgaacccgggtttaccccgaaccccccggttaccgacctaacccggccccgtttcccgggaaccccggg

SEQ ID NO: 43409 - DNA, 796 bp, Homo sapiens
  misc_feature: GYAE6OF01BX4C0.31.14.B03.1.454.CMB.1.raw
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctggagactctcctgtgccatgtctgcgtctgtaattcacgttcctcgaggctacgtatggctatcgcgacggtcgggtcccgaccgacgggccccgaggaccgaagggcgtgggngggtagggtcgtactaagttttaactaacgtaagttttggaaggtaggtaaagttaaaaactttaaaaacgtttcggactaacgtaacgttccggtaagggtaaccgggccgttattaccgaacctacttaccgtaccgaacggtacctacccccttaaccaaccgtaagttaccgtcttacgtaactaccgttaaaccaaagttaccgaaacgtaggttcggtaacgaacgtaggttaacgaaacggaccgtaacgtactttaaacgtttaagttaggttcggaagtaacgtaacgtttaggtttacggtttacggtaaccgatacgtaatacggtaagttcgggtagtaaggtcgggtcgtacgtacggtaccgaccggggttacgggaccggtaaacgggtaccgtacgttaccggacccttaccgtcccttaccgcgtacctcccgtaacgacccgggtaccgtcgtacccgttccggtcccttcccgacgtacccctacccctagaaccgaccgtccgacgtcccgg

SEQ ID NO: 43410 - DNA, 774 bp, Homo sapiens
  misc_feature: GYAE6OF01EDH2N.31.14.B03.1.454.CMB.1.raw
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
tcagcagtagacgtcacgaccggtgctcgatttagtgtgagtagtttgggctgagcgtgggttttcctcgttgctcttttaagaggtgtccagtgtcaggtgcaccgtggtggaatcgtgggggaggcgtggtccggcctggggggtccctgagctctcctgtgccatgtctgcgtctagtaattcattcctcgaggctacttagtggcatcgcgacgtcgggtccgccacgggcccaggacgaagggactgggaggtgggtcgatatttagactaagttgagtaggtaaataaattaaaactttcgatacgacgtacggaggacggacctatccacncttcacgacgtacctaccctaccaacgctacgtcgtattactacctaacaanacgaacgtagtacggtacgacgtaagttaacggaagaaccgtaacggtaacctttaaacgtttaagtttacgttggtaacgtaaccggtttaaaggtttacgttttcgggtttaagggttacgaacgttacgtaatacgtaaggttcgggtaagaacgggttagggtccgtacgtaccggtaaccgtccgggtacgggtaaccgaacgggacttaacccgggtggttaccctaccgtcctacccgtaccgcgttacccccaccggtaaacccggtacccggtaccccgtaccggtttcccccggttacccccgttaccccccgacccgtcccccgttaacccccgtactaaccccggaaacggtcccgtcccggtaaccccggg

SEQ ID NO: 43411 - DNA, 823 bp, Homo sapiens
  misc_feature: GYAE6OF01CSBJH.31.14.B03.1.454.CMB.1.raw
  modified_base (290)..(290): a, c, t, g, unknown or other
  misc_feature (290)..(290): n is a, c, g, or t
  modified_base (666)..(666): a, c, t, g, unknown or other
  misc_feature (666)..(666): n is a, c, g, or t
  modified_base (797)..(797): a, c, t, g, unknown or other
  misc_feature (797)..(797): n is a, c, g, or t
tcagcagtagacgtcacgaccggtgctcgatttagtgtgagtagtttgggctgagcttgggttttcctcgttgcttactttttaagaggtgtccagtgtcaggtgacaccgtggtagaatcgtggggagcgtggtccggccgtgggggtccctagagtactctcctgtcgcctattgtctggcctctagattctactccgtgaggctactagtcggcaatcgactacggtcgggtcccaccgcggaccccgaggacgaaggtccgtgggacggttgggtagtctatttanactatttgacgtacgtaaagtaaactttaaaaacgtttcgacgtaagtacccgttaccggaaggtacccgggtactacgtttaccaaccgtacttacctaccggagtaaacccgttacccttaaccgaacctaagttaccggtaccttacgttaacctaccgtaacgtaaaacgcgtaaaccgtaggttacggacggttaaacggaacgttaccgggaaataacccgaaacggtaacttaacgtttttaagtcgtttaacggagtaaacgtaacggttttacgttacgggtttacggtacaacgtacgtacgttacgtaagtggtacggtagtacgggtacgtacgacgtaaccgtacggtacgggaaccggtaanaaccgtcgttccgtaaccgtcccgttacggtcccgtaccggaccgtttcccgaaaccccgttacgggaaacccccgtacgtcccgttacccggttcccgtaccccccgttacggtacctaccccccgttanaacccgtaacgcgtacccgtacgggg

SEQ ID NO: 43412 - DNA, 740 bp, Homo sapiens
  misc_feature: GYAE6OF01E0QCK.31.14.B03.1.454.CMB.1.raw
  modified_base (195)..(195): a, c, t, g, unknown or other
  misc_feature (195)..(195): n is a, c, g, or t
  modified_base (464)..(464): a, c, t, g, unknown or other
  misc_feature (464)..(464): n is a, c, g, or t
  modified_base (523)..(523): a, c, t, g, unknown or other
  misc_feature (523)..(523): n is a, c, g, or t
  modified_base (543)..(543): a, c, t, g, unknown or other
  misc_feature (543)..(543): n is a, c, g, or t
  modified_base (610)..(610): a, c, t, g, unknown or other
  misc_feature (610)..(610): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgttctgtaattccattccctanaggcacttagtggcagtgctacgtcgggtccgaccgacggccccaggcgaagggactgggagtgggtgactatttaagtactaattgagtaggaacgtaaaatttaaaaaacttttaccggacaacgtaccgttaccggtacggaaagggcccgtaattaccgaaccacgttaccgtaccaagtaacccgtaccccgttacctaaacccgtaagttaccggcgttaagttacttaccgtaaacctaaacgtacgtaaacagttaggtanaacgtaagttagaacgtaacgacggtaataaacgtttattagtagtagaacgtaaagtntttacggtggttacgacgtnaacgtagtaatgggtaggtaagtagggtcgaccgtacgtaaccgccggtagggaccgtaagggaccngttaccgccaccgtctaccctcgaaccgtccgtacccgaaccgaacggtacccgttaccgtcccggttacccttccccggaccgtacccgtaccccgtaccttaccggaacgaccggtccgtaaccccgg

SEQ ID NO: 43413 - DNA, 1021 bp, Homo sapiens
  misc_feature: GYAE6OF01AUDXK.31.14.B03.1.454.CMB.1.raw
tcagcagtagacgtcacgaccggtgctcgatttagtgtgagtagtttgggctgagctgggtttttcctcgttgcttcttttaagaggtgtccagtgtcaggtgcacctggtggaatcgtgggggaggcgtggtcccggccgtggggggtccctgagactctcctgtgccatgtctggccgtctagtaattcactccctcgaggccaactagtggcatcgctacgtcggggtcccgccgaaccgggccccgaacgggtacggaagggtaccgtgggagggtggggtcggtaccttaagttttaataacgttaagttttgaagtaggtaaacgtaaaatttaaaaaaccgttttacgacgtaacgtaccgtaccggtaacgggaacgggtaccctacttaccgtaacctactaccgtaccgaacgtacccgttaaccccctttaccaaccgtaacgtaccggttaccttacgtacctttaccgtaaacctaaacgtacggtaaaacctcggttaggggttaacctaacggtttaaaggttacggtaaaacccggtaacccgtaaaccggttaaccttttaaaaccgttttaacgttttaaggttacgggttaacggtaaacggttaaacgtttaaccggtttttcgggtttaacgggtttaaccggaacgttaaacttaacgtaacgttaaaggtttggggttaaacgggttaagggttacgggggtacccttaacgggtaaccccggtaccgggttaacccgggggacgggtaaaccccggtaacggggtaaccggttaacccgttacgggtacccccgttaacccggttaccccgttacccctaccggtaccccgtaccccggtaaacccccgtaacggggtaaacccccgggttcccccgttaaccggtttacccccgggttccccccgtttacccccgggaccccggttaaaccccccgttacccccctaccggttaaacccgggaacccggtacccgttaaccccgggttacccgggg

SEQ ID NO: 43414 - DNA, 863 bp, Homo sapiens
  misc_feature: GYAE6OF01D74DE.31.14.B03.1.454.CMB.1.raw
  modified_base (205)..(205): a, c, t, g, unknown or other
  misc_feature (205)..(205): n is a, c, g, or t
  modified_base (448)..(448): a, c, t, g, unknown or other
  misc_feature (448)..(448): n is a, c, g, or t
  modified_base (799)..(799): a, c, t, g, unknown or other
  misc_feature (799)..(799): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggaggcgtggtccggccgtggggggtccctgagacctctcctgtgccatgtctgcgtctgaattcatcctcgaggactaacttagnggcagtcgccacgtcggggtcccgccgaccggcccccgaaggacgaagggacgtggggaggtcggggtggtactaattttaataactaagttttggaagtagggtaaacgtaaaaagtttaaaaaaacgtttttccggactaacgtaccgtacccggttaagggaaaccgggtaccgttaactacctaacccacttacccgtacccgaacgtacccgtaaccccttaccaaacccattaccgngttatactacctaaccaaatacgaacgtagtcgggtaacgaacgttaggtaacgaaacgaccgtaacccggactttaaaacgtttaagtttacggttaggtaacggtaacgggtaaagtttccgttttaacgggttaggtacgtaagacttaaacgttagtaagttgggtacgggtaagacggggtttgcccgtacggaacccgtacggggaccggtaaccgggaaccggaaccttacgggttccgtacccgtacccgttcctcccgtaaccggccctacccccgttacccgaaacccgggtacccggtacccccgtaggtttccccccgttacccccgggtttacccccncccggggtaacccccctacccccgtaccctaacccggtaacgccccggtcccttaaccccgggg

SEQ ID NO: 43415 - DNA, 935 bp, Homo sapiens
  misc_feature: GYAE6OF01A8OEK.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgtggtccggccgtgggggtccctgagactctcctgtgccatgtctgcgtctgaattcatcctcgaggcactatggcatcgcacgtcgggtcccgccgacggccccgaggaccgaagggactagggacggttggggtcggactaagttttaactaacgttaagttttgaagtagggaaagtaaaacgtttaaaaaaacgttttaccgactaacggtaccgttaccggtacggtaaacggggaccgtaacgttaccgaacctaacttccgtaccgaacggtaaccgttaaccccttacccgaaaccctacgtaccgtacttacgtaacttacctaacctaaacgtacgaaacctacgttacggtacgaacgtaggttaacgtaaacgaccgtaacgggtaacctaaaccgttttaagttacgtttaggtacgggtaaccgtaaaggttacttttaccggggtttagggtttaccggaacgtaccgttaaacgttacgttaaacgggttagggttaacggggttaacggttacggggggttacggtccggttaaacccggtacccgtaacccggggtttcggggggaaaccccgaaggggttaacccttacgggttacccggttaccggtaccccgtttacctacccggtaacgtacccggtcccgttaaacccgaaaccccgggtaacccgggtccccgttaacggttcccccgggttaccccctttaccccccgggtaccgtaacccccgttaccccccgttaacccgtacccgaaacccggtacccggtaaccccgttaaccccgggg

SEQ ID NO: 43416 - DNA, 959 bp, Homo sapiens
  misc_feature: GYAE6OF01BRMH8.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtcggggggtccctgagactctccgtgtcgccatgtctgcgtctagtaattcactcctcgaggcactagtcgctagtcgacctacgtcgggtccccgaccgaccgggaccccgaggaccgaaggggtacgtagggtacggtggggtacgtacttaagttttaacgtaacttaagttttggaagttacgggtaaaagttaaaaattttaaaaaaacgttttacccgacgtaacggtacccgttacggtaacggaaaccggggtcctaagtttacccaaccgtacttccgtaccgacgtaaccgtaacccctaccaaacctactcgtacttacgtaactacctaacctaaagtacgtaactaggttaggtacgtaagtacggttaacggaacgtaacccggtacgtaacctttaaagtttaagttttagttacgggtaacgtaaacggttaaaggtttacgttttacggggtttacgggtaacggtaatacgtaacgttaacgtaagggttcggtagggtaaggttcggggttacgacccggttaccggtaacccggtaccccggggtaacggggggtaacccggtaacggggttaaacccggtacccgggtttaccgggacccccgtttaaccccgggttcccctttacccggacccggttaaccccgtacccccgttaaaccccggaaccccggggttaaccccgggaccccgtttaacccggtttccccccgggttaaccccgttcccccccgggttacgacccccccttaccccgtacccgtaaaccccgaaccgtcccggtccccggtaaccccgggg

SEQ ID NO: 43417 - DNA, 853 bp, Homo sapiens
  misc_feature: GYAE6OF01DZOE0.31.14.B03.1.454.CMB.1.raw
  modified_base (121)..(121): a, c, t, g, unknown or other
  misc_feature (121)..(121): n is a, c, g, or t
tcagcagtagacgtcacgaccggtgctcgatttagtgtgagtagtttgggctgagctgggtttcctcgttgcttctttaagaggtgtccagtgtcaggtgcacctggtggaatcgtggggngcgtggtccgcgtgggggtcctgagctctcctgtcgacagtgtctgctcgtagaattcacgtcctacgagtctacgtagtggctagtcgaccggtagttccggggacccgaccgaacccgggtcccccggaaaggacggaaacgggtccggtagggggtaaggttcggggttcgaatttaacttttaagtaaacttagtttaggtagttaaggaaattaaaacgtttaaaaaagtttccgacgtacgtaaccgttccggtaacggaccggtacgtaccttacaccgtactacgtaccgacgtacccttaacccgttaccaacctaacgttaccgtacttaggttaacctacctaaactaaacgtacgtaacgtaacgttacgtaacgtaaccggtaaggttacgaaacgtacgacggttaactttaacggttattaagtttacggtaacggtaacggtaaagtttccgttaggtttaggtcgtaacggtactagttaacgtaaggttgggtaggttagggtacgggtcgtacccggtcgaaaccggtcgggtacgggacgaacggtaccggttacgtaccgtaccgtctacctaccggtacctctaaccccggtacccgaaccggtacgggtcccccttacggttaccccggtttcccccgtccccgttaacccgttccccccgtaagtaccccccgtaccgtaaacggtccccgtaaccgtaaccccgggg

SEQ ID NO: 43418 - DNA, 814 bp, Homo sapiens
  misc_feature: GYAE6OF01BZZQQ.31.14.B03.1.454.CMB.1.raw
  modified_base (805)..(805): a, c, t, g, unknown or other
  misc_feature (805)..(805): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgctctgaattcactcctcgaggctaactagtcggctagtcgacctacggtcgggtcccgaccgacggcccccgtaggaccgaagggaccgtgggtacggtgggtcggactagttttaactaacgttaaagttttggagttacggtaaacgttaaaaagttttaaaaaaacgttttccggactaacgttaacccgttaccggttaagggaaacggggtcccgtaactttaccaaccctacttccctaccgaacggtacccgtaacccccttaaccaaccctagtacgcttgtactccgtaaccaactagactagtcggtacgtaagtacgtagaacgtaccgacgtaaccttaaatttagtttagttacggtaacggtaacgtaaaggtttacgtttcgggtttcggttacgagtactacgttactaaggttcggtagggttaacgggtcggggtacggtccgtccggtaacccgtaccgggtcggggtaacccggaaaggtaacccgtacgggttccgtacccgtcccgttcccgtacccgtcgacccgtacccgacccgtaaccggaacccggttcctccggttccccggttccctccccgacgtccccctacccgtcccgaacctaggcccnccgtaccgg

SEQ ID NO: 43419 - DNA, 690 bp, Homo sapiens
  misc_feature: GYAE6OF01BT13Z.31.14.B03.1.454.CMB.1.raw
  modified_base (592)..(592): a, c, t, g, unknown or other
  misc_feature (592)..(592): n is a, c, g, or t
tcagcagtagacgtcacgaccggtgctcgatttagtgtgagtagtttgggctgagctgggttttcctcgttgctacttttaagaggtgtccagtgtcaggtgcacctggtgaatcgtggggagcgtggtccggccgtgggggtccctgagactctcctgtgccagtgtctgcgtctagtaattcattcctcgagcacgtagtggcagtcgacctagtcgggcccaccgacggcccccgaggaacgtagggtacgtgggaggtgggtacgtactattttacgaacttaagtttaggaagtacggaagtaaaatttaaaaaacgtttcgactaacgtaccgtcggtaggaaccggccgttacttaccaccgtactccgacgacgtacccgtacccttaccaacgtataccgcttatactaccgtaactaaatagactaggtcgtagaactagttacgaacgacgtacgtaactaagtttatacggttgtaacgaacgttagtagtttccggttgttacgagtacacgttacaagttgggtagtaaggtcggtcgaccgtcgaacgcggtacgggcgaacggactccggtgtccnccgttcgtaccgtcacccgactaccgaaccgtcgaccctaggcccgtttcccgccccgtacgcctccccctacgtacccgaacgccgtaaccctcggg

SEQ ID NO: 43420 - DNA, 915 bp, Homo sapiens
  misc_feature: GYAE6OF01BMUDJ.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggttttcctcgttgctcttttaagaggtgtccagtgtcaggtgccaccgtggtggaatcggtgggggagcggtggtcccggccgtcggggggtccctagagtactctccgtgtgacctagtcgtctggccgttactagtaatttccgacttcccncgaaggctaaccgttagtgggacctagtcggacctaccgggttccgggcccgacccgaaccggggccccgaaagggaccgtaaaagggggtccgtagggggtagggttagggtagacctttaaatttaataaccgtaagttttggaaagtaggtaaagtaaaattttaaaaaacgttaccgtaagaaaccgttacggtaccggtaacggaacggggtaccttaacttaccgaactaccggtacctaccgaaggtaacccctaaccccttaacccgaaacctacgttaacgtaccttacgtaacctaaccgtaacgaaacgtaacgaacctaaggtcggtaacgtaacgaacggttaaagaaccgaccgtaaacggtaaacttaaagtttacgtaaggttacgacgtaacgttaagggttagtttaccgggttagggtacctagtacgtaagttacgaaagggtttgtaaggggttaacggtcggggttaaccgccggttaaccggtaacccggtacggggacgggaaccgtaacggacgttaccggtacggtaccgttacccgtccacgttaccgaacccgtcccgtaccgaaacccgggaccgttaccccgtaggttcccccggttcccctaccccggtaccccgaacccccttacccgaaccccggttaacggacctaacccgccggttaaaccccgggg

SEQ ID NO: 43421 - DNA, 828 bp, Homo sapiens
  misc_feature: GYAE6OF01DT2KS.31.14.B03.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (558)..(558): a, c, t, g, unknown or other
  misc_feature (558)..(558): n is a, c, g, or t
tcagcagtagacgtcacgaccggtgctcgatttagtgtgagtagtttgggctgagctgggtttcctcgttgctctttaagaggtgtccagtgtcaggtgcaccgtggtgaatcgtgggggaggcgtggtccggccgtgggggtccctgagacctctcctgtcgccattgtcctgcgtctgaattcattccgtnaggctactagtggccatgcctacgtcggggtcccnccgacggtcccccaaggccgaagggccgtgggacggtgggggtnactagtttatacgtaatttgacgtaggaataaagttaaaaacgtttcgacgaacgtccgtccgtaggacgggtcctattaccacctagttcccgacgagaacccgtacccttaccgaacctattaccggtacttagtaacttacccgaacgtaaaaccttgaaacgtacgttcgggttacgaacgttacggttaacgaacgtacgaccgggtaaccttaaagtttgttacgtacggagtaaccggttaaagttccgtttacggggttacgttacggaaacggtttnaacccggttataaagggttcggttacgggtaagggttacgggtcgggtaccttaccggaacgttacccggggtagggaaccgttaaagggacccgttcgtaccggttaccttaccccggcgtttcccgaacgttccgtaaccccgtacccggtaaccggtacccgggtacccgttacgttaccccccgggtttccttacccccccggttaggacccccctcccggtttaaccccaaccggttaaacgaccgggttccccgtaaacccggg

SEQ ID NO: 43422 - DNA, 884 bp, Homo sapiens
  misc_feature: GYAE6OF01DOW2G.31.14.B03.1.454.CMB.1.raw
  modified_base (820)..(820): a, c, t, g, unknown or other
  misc_feature (820)..(820): n is a, c, g, or t
tcagcagtagacgtcacgaccggtgctcgatttagtgtgagtagtttgggctgagctgggtttcctcgttgcgtcttttaagaggtgtccagtgtcaggtgccacgtggtggaatcgtggggagcgtggtcccggccgtgggggtccctgagactctccgtgtcgccatgtctgcgttctagaattcaacgttcccagacggcctacgtagtcggactaagtcgacctacggtcgggtacccacccgacgggaccccgtaggaccgaacgggacgtgggtagggttcggagtacttaagttttactaacgttaagtttacggaagtaaggtaaagtaaaatttaaaaaacgttttacgacgaacgtaaccgtccggtaaggaacggtaccctacttaccgacctagtaccgtaccgacggaacccgtaccccttaacgaaccgtaacgtaccgtcttacggttaacctacgtaacccgaaatcggaaacttggtaggttagaaccgttaagttacgaaaccggtacccgtaaccgttaacgtttaaaccgtttaagtttacgttaggtaaccgggtaaacgttaaacgtttcggttttaccggttacggtaacgtacgacttaacgttaacgttaggtacggttaagggttaggtaccgggttcgtaccgtaccggtaaccggtaccggggttaccgggaacaacggggttaacccaccgggttactaccccgtaacccgttcgtacccgtacgacccccgttaaccgaccccgttaaccgggaccggtccccgttaacggttcccccggtttacccccncccccggttcgtacccccccgtacccgttacctaccgggaaaccctcgtacccccgtaccgggg

SEQ ID NO: 43423 - DNA, 904 bp, Homo sapiens
  misc_feature: GYAE6OF01AQILW.31.14.B03.1.454.CMB.1.raw
  modified_base (785)..(785): a, c, t, g, unknown or other
  misc_feature (785)..(785): n is a, c, g, or t
  modified_base (848)..(848): a, c, t, g, unknown or other
  misc_feature (848)..(848): n is a, c, g, or t
  modified_base (883)..(883): a, c, t, g, unknown or other
  misc_feature (883)..(883): n is a, c, g, or t
tcagcagtagacgtcacgaccggtgctcgatttagtgtgagtagtttgggctgagcgtgggttttcctcgttgctcttttaagaggtgtccagtgtcaggtgcaccgtggtggaatcgtgggggagcgtggtccggccgtgggggtcctggagactctcctgcgccagtgtctgcgtcgtgtaacttcatccctacgaggactaacgtgtcggacctagtcgaccgtaccggtcgggtcccgaccgccggaccccgaggtacgaagggtcgtggtacggtcgggtggactaactttacgtaacttagtttggtaagtacggtaaagtaaacgtttaaaaaacgttttcggaacgtacgtaaccgtaccggttaaggaaccgggttaccccgtaacttacccgaaccgtaacgttcccgtaacccgaacggtacccgtaacccccgtttaaccccgaaacccgttaaccgtacccggtacgttacgttactttaaccctaaccctaaacggtaacctaaacgtaacggtttacggggacgttaaacggtaacggttaacggaaaccgttaaccggaaccggttaacctttaaaccgtttaaattacggtttgaaaccgtacggtaaacgttcgtttacggtttacgggtaacgacgtacgtactaacgtaagggttcgtaggtaaggttacccggggtagtacccgtacggaaccgtacccgggtacggggtaacccgaacgggtaaacccgttccggtttaccgggtccccaaccgtttaccccnccgttccgtaccgcccttaccccggaaccggacccgttacccgtacggttccccggttccccnccccgtacgtccccctaccccgttccgtaaacccnccggactaccccgtcccgggg

SEQ ID NO: 43424 - DNA, 832 bp, Homo sapiens
  misc_feature: GYAE6OF01AB462.31.14.B03.1.454.CMB.1.raw
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggctgagctggtttcctcgttgctcttttaagaggtgtccagtgtcaggtcgctaccgtggtggaatcgtgggggagtcgtggtccggccgtgggggtccctgagactctctgtgccatgtctgcgtctgaacttcactccgtacaggctactagtggctatcgctacgtcgggtcccgacccgcggacccgagggtaccgaaggggtaccgtaggtaggtggggtgacttagtttaaccgaattagtttaggaacgtggtaaagttaaacttaaaaaacgttttccgactacggtaccgacggttacgaacggggaccttataccaccgtagtaccgtaccgtacgtaccggtaccccttaanaaccccgtataccggntttacgtaactccgtaacctaagtacgtacgtagtacggtacgaaccgttggtaaacgaacggaccgtaaacggtctaaacgtttntacgttagacgtaaggtaacgttcgtttaacggtcgtaacggatacttacgtaacgtaaagtcgggttaggtaacggttaccggtgtaccgtccggtaaccggttacccgggtaagggtaacccgtaagggtaaccgttacgggttacggtttccccggacctttacccgtaccgtaacgaccccttccccggtaaaaacggcccccttaacgggggtcccttaaccccggggttccttcccccgggttaaaccccgcgggttcccccttaaacccccgcgttaacccggaaccgtttccgacccgttaccccggggg

SEQ ID NO: 43425 - DNA, 845 bp, Homo sapiens
  misc_feature: GYAE6OF01CHZLU.31.14.B03.1.454.CMB.1.raw
  modified_base (713)..(713): a, c, t, g, unknown or other
  misc_feature (713)..(713): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcgtggggaggcgtggtccggccgtggggggtcctgagactctcctgtcgcctatgtctgcgtctagtaattcactcctacgaggctaacttagtggctagtcggaccgtacggtccggggtcccgccgaccgggacccccgaagggaccggaaacgggtacgtggggtagggtgggtacggtacttaagtttactaacgttaagtttggaagtaaggtaaaagtaaaaattttaaaaaaacgtttccgactaacggtaccgttaccggtaagggtaaccgggtaccgtacttaccaacgtactccgtaaccgacgaccgtaccctaccaactacgtaccgtcttacgtacttacctaaccgtaaagtacgtaaacgtaggtagggtaacgtaagtaaggtacaaaacggtaccgtaccgttaaacttaagtttagttacgtaggtacgtaacgttaaaggttcgttacggtttaggtacgaagtactatagtaaggtcgggtaggtaagggtacggtccggtacctaccggaaccgtaccggggtacgggaaccctaaaggggtacccgtaccggttccggtaccctacccggttccncccgtaccgtaccgtccccgtaaacccgtaaccggtaccgtccccgtacggtttcccccggtccccttacccccgggactacccccttaaccccgtaccgttaaacccgacggtcctaccccgggttacggg

SEQ ID NO: 43426 - DNA, 954 bp, Homo sapiens
  misc_feature: GYAE6OF01A799Z.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccgacggccccagggacaagggcgtggacggtgggtgctatttatactaagtttgagtaggaataaattaaaaagtttacgactaacgtacctccggtaggaacggggtaccgtactttaccaacctacttcctaccgaacggtaacccgtaacccctttaaccaaaccccgtaacgttaaccggttaccgttacgtttaacccttaacccttaaaaccccgtaaaaagttaacggtaaaaccctaacgggtttaaggggttaaccgtaaacggttaacgggttttaaacggaaaaccggtaaacccgaaacccggggttaaactttaaaacgtttttaacgttttaaagtttaccggggttaacggtaaaccggttaaaagggtttaccgtttttaccggggtttacggggtttaaccggaacggttaacctaaacgttaaccggttaaaggttggggttaacgggtaaagggttacgggggttcggacccgttaccggtaacccggtaccggggttaccggggaacccggaaacggggtaacctaccggggtaccgggttacccgtaccccggttaccctacccgtaccgtaaccccgggtacccctacccggtaaaaccccggacccgggttacccttaccgggttcccccggtttaacccttcccccccggacgtaccccccgttaccccgttaccccgaaaccggtacgacccggtacccgtaccccggg

SEQ ID NO: 43427 - DNA, 893 bp, Homo sapiens
  misc_feature: GYAE6OF01EL6R3.31.14.B03.1.454.CMB.1.raw
  modified_base (450)..(450): a, c, t, g, unknown or other
  misc_feature (450)..(450): n is a, c, g, or t
  modified_base (874)..(874): a, c, t, g, unknown or other
  misc_feature (874)..(874): n is a, c, g, or t
tcagcagtagacgtcacgaccggtgctcgatttagtgtgagtagtttgggctgatctgggttttcctcgttgctcttttaagaggtgtccagtgtcaggtgcacctggtaggaatcgtgggggagcgtggtccggccgtggggggtccctgagtacttctcctgtcgcctatgtctggcgtatgaacttcatcctcgaggtccacttagtggactagtcgaccgtacggtcggggtcccgacccgaccggcccccgaaggacggaagggtccgtagggggtaggttcggggtggtacttaatttaactaagttaagtttaggaggtaggtaaagttaaaacttaaaaaacgtttcgaactacgtaaccgttccggaaggtaacggtacccgttacttaccaaccgtaactccgtaaccgacgtaacccgtaccccttaaccaaaccttanaccggtcttagttacctacctaaacgtaaagttacgaacgtacggtaggttaacgacggttaacgttaaggaaacccggtagtaaacccggtaactttaaacggttttaatttacggttaacgggtaaggtaacggtaaacgtttccgggtttagggttacggttacggacgttaacaacggttacgttaaagggtttgggtaagggttaacggttcgggggtacgtacccggtaacggtaaccccggggtagggtaccgggaacccgggttaaacgggaccttacgggtacccggttaccgtaaccccggttctaccctccggaaccctccccgtaacccgtaaccgggacccgtccctaaccgggtttccccgtccccgttcccggaccctaccccggtaccccttacccgaaccggtaccnccggtaacttaccccgggg

SEQ ID NO: 43428 - DNA, 777 bp, Homo sapiens
  misc_feature: GYAE6OF01BZZRO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctagaattcactcctcgaggcactatggcagtcgcacgtcgggtcccgccgacggccccgaggacgaagggacgtgggaggtgggtaggctatttactactaagtttgagtaggaaagtaaatttaaaaaacgttttacgactaacggtaccgttccggtaggaacgggtccgtacttaccgaacctactccctaccgaacggtaccgtaaccccttaccaaacctacgtaccgtcttagtactacctaaccaaacgtacgaactagtggtacgacgtagtacgaacgacgacgtactaacttagttattggtacgtacgtaagttacgtttcggttagtacgagtactatacgaagtggtacgggtaggtagggtcgacgtacggaccgtaccgggtcggggacgaacggtacctccggtacggtacccgtaccgttcctcccggtaacctacccgtaccccgtacccgaaccccgggtaccggggtaccccttaccggttccccggtttcccccgtttacccccggtaccgggtaccccccttaacccccgtttaccccgaacccgggtaaccgtccccggtacccggttaaccccggg

SEQ ID NO: 43429 - DNA, 806 bp, Homo sapiens
  misc_feature: GYAE6OF01AG4BN.31.14.B03.1.454.CMB.1.raw
  modified_base (188)..(188): a, c, t, g, unknown or other
  misc_feature (188)..(188): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactagtggctatgctaccgtggggtcccnccgacggcccccgaaggcgaaaggggctaggggagtggggtgctaagttttataacgtaatttaggaagtaggtaaacgtaaaatttaaaaaaacgttttaccggacgtaacggtaaccgttaccggtaacgggtaaacgggtaccgttaactttaccgaaccctaactaccgttaacccgaacggtaaccgttaaccccctttaacccgaaacccgtaacgtacccgtacttacgtaacttaccctaaccaaaagttacgaaacgtagtggtaacgacgtaagttaacggaacgtaccgaacggtaaccttaaatttaagtttagttacggtacggtaacggttaaaagttacgttttaccgggttagggtttaaccgaagtaccgttaactaagtaaagttacgggtaggtaaggttacggggtacgtaccgtacgaaccgtacggtacggggaaccgtaagggactacggttacgaccgtccgtcctcctacgactccctaccgaaccggacggtccctacgtccgttacccgttccccgacgtacccctacccttacccaacaccggtccgcccgtaccgg

SEQ ID NO: 43430 - DNA, 936 bp, Homo sapiens
  misc_feature: GYAE6OF01ALCQ2.31.14.B03.1.454.CMB.1.raw
  modified_base (617)..(617): a, c, t, g, unknown or other
  misc_feature (617)..(617): n is a, c, g, or t
tcagcagtagacgtcacgaccggtgctcgatttagtgtgagtagtttgggctgagcttgggttttcctcgttgcttcttttaaggaggtgtccagtgtcgaggtgccaccgtgggtaggaatcggtgggggaggtcggtcgggtcccgggccggttcggggggtccctggacgacctccttccgtggtcgcctagttcgtcgtcgtcgttctagtacttaccacttccctacgacgtcctacgttagcggcttagtacgtccgtaccgggttccgggtacccccggacccgacccgggacccccggtaagggaaccggtaacgggcggttggggaggggttcgggtacgtactttaattttacgtaagttaagttttaggagttaagggtaaaaccttaaacgttttaaaaacgtttccgacgtaacggttccctaccggggagggtaaccggtccgttaacttcccgaacctactaccgttacccgaacggtaacccttaccccttaccaacgttaactcgtacgtttaccttaacgacccttaaagtaaacttacgtaaacgtcgggttaaacgtccgtaacgtttaaggaaccggtaacgtactaaacccgttntaaaacttttcggtagtagtacgtaacgttaaggttcgtttcgttaaggtccgtaagtactacgtaagttacgtagggtaggtacggtaggtacccggtaccgtaccggtacggtccggtacgggaccgtaaacgggtacccgttccgtaccggttcccaaccggttcccgtacccgtccgtaacccggtaccccgttaaacccggacccggtaaccccggttccccggttccgtttaccccgggtacccctttccccgggtaaccgtaaccccccttccggtaacccgtaaccggaccgtcccgtcgggttacccggg

SEQ ID NO: 43431 - DNA, 753 bp, Homo sapiens
  misc_feature: GYAE6OF01CU78T.31.14.B03.1.454.CMB.1.raw
  modified_base (194)..(194): a, c, t, g, unknown or other
  misc_feature (194)..(194): n is a, c, g, or t
  modified_base (654)..(654): a, c, t, g, unknown or other
  misc_feature (654)..(654): n is a, c, g, or t
tcagcagtagacgtcacgaccggtgctcgatttagtgtgagtagtttgggctgagctgggttttcctcgttgctcttttaagaggtgtccagtgtcaggtgcaccgtggtggaatcgtgggggaggcgtggccggccgtggggggtccctgagactctcctgtcgccattgtctgcgtctagtaattcatcctnaggtactagtcggcatgctacggtcgggccgccgacggcccgaggcgaagggtacgtgggaggtggggtgaccttaattttacgacttaagttgagtagggaaagtaaaatttaaaaaacgttttcgacgtaacgaccgttacggtacggaaaccggggtcctaacttaccgaacctacgttacctaccgaacggtaacccgtacccctttacccgaaaacctacgttacgtctacgttactacctaaccaaatacgaactgtaggtatacgagtacgaacgacgtacggtacttaaatttagttagttaggactaacgtaacgttaggtttcggttaggtacgagtactacgtaagtaagttggagggtaggttagggtcgtaccgacggtaccggaccggtcggggaacgtaacgggaactaccggtcgtaccgtccgtcctccgtacgccgtacccnccggaaaccggtccggtaccgtccggttcccgttccccgttaccccggcctaccccgtcccttacccgaaccgacgacctccggttccggtaccggggg

SEQ ID NO: 43432 - DNA, 835 bp, Homo sapiens
  misc_feature: GYAE6OF01BB0AN.31.14.B03.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggccggcgtggggggtcctgagactctctgtgcatgtctgcgtntagaattcatccncaggcatatggcatgcacgtcgggccnccacggcccaggcgtaagggctgggaggtgggtgactatttanaactatttagataggtaagtaaattaaaaatttcganacgtactacgtaggaacgggacctatactaccgactaccaccgaacgaaccgtaccccttaccaaacctacgtacggtaccttagtaactaccctaacaaatacgaaatacgtagggtaagaagtaacgttaaggaacgaaccgtaacggaacttaacgtttaattaacggtacggttacgaacggttaaacgttacgtttacggggtttacggttaacggtaacgtacgtaactaaacgtaaacgtgggttaacgggtaagttacgggggggtaccgtaaccgtacggtaaccccgggtaacgggtaaccgggggggtaccggaaaccgggttaaaccggtcgggttaacccgggtaccgtaaccggttcccgtacccggtagaccccgtaaccccggtaccccgaaaaccgggtaaccccggggttccccgttaaggttaccccggggttcccccgtccccccggtttaacggaaccccccgttaccccttaccccccggaaaccgttaacggtaaccccggacccggttaaccccgggg

SEQ ID NO: 43433 - DNA, 852 bp, Homo sapiens
  misc_feature: GYAE6OF01EG9KO.31.14.B03.1.454.CMB.1.raw
  modified_base (244)..(244): a, c, t, g, unknown or other
  misc_feature (244)..(244): n is a, c, g, or t
  modified_base (648)..(648): a, c, t, g, unknown or other
  misc_feature (648)..(648): n is a, c, g, or t
  modified_base (815)..(815): a, c, t, g, unknown or other
  misc_feature (815)..(815): n is a, c, g, or t
tcagcagtagacgtcacgaccggtgctcgatttagtgtgagtagtttgggctggagtctgggttttcctcgttgcttcttttaagaggtgtccagtgtcaggtgcaccgtggtggaatcgtggggagcgtggtcccggcgtgggggtccctgagactcgtcctgtcgccagtgtctgcgttctagtaattcactccgtcgacggctactacgtggctacgtcgaccgtacggtccgggtacccnccgaacggccccgaagggtacgtaagggtcgtagggtacggttgggtacgtacttaacgttttaataacgttaagtttaggaagtaaggtaaacgttaaaaactttaaaaaacgtttccgaaccgtaaacgtaccggttaccggtaacgggaacgggtcccctaacgttacccaacccgtacgttcccgtacccgtaaggtaaccccgtaacccctttaaccccgaaaccgtagtacccgttaccgttacggtttaacctacccgtaaccgtaaaagtacggtaaaccgtaggttacggtacgtaacgtaacggttaacgaaaccgtacccgtaaacgtacgtttaacgtttaagttcgttaacggtacggtaacgttaaaggttcggtttacggttaccgtanaacgtataacggttagaacgttggtacggtaaggtcggtacgtacccgtcggaaccgtcgggacggaccgaacggttaccgtacgtccggtacctcccgtcctaccgtaccgaccgtcccaaccgaccggtaccgtaccgttcggtacccgtccccgttaccccggntaaccccttcccaccgaacgacggcctcgtacccggg

SEQ ID NO: 43434 - DNA, 571 bp, Homo sapiens
  misc_feature: GYAE6OF02HOQ23.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagcgtggtttcgcgtaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctgggagtgggtggcattttanacaatttgatggagataaaaattttacgcagactccgtgaaggccgattcaccatctccagagacccttccaaccatacgctgtatctccaaatgaacatggtgacagttgaagacacggcaacttattattgtgacgaaagtatttcgttggttcgagcatcaatgtggatagggtgctcgacaccgtggggccagggaacacgtggtccaccgtcgtcctcgacgccctccaccgaacgggcccaacgttccgggtccctttcccccccgtgggcccctaccccttcccgttacccaaacggacgccctaaccccgg

SEQ ID NO: 43435 - DNA, 609 bp, Homo sapiens
  misc_feature: GYAE6OF02I40CX.31.14.B03.1.454.CMB.1.raw
  modified_base (251)..(251): a, c, t, g, unknown or other
  misc_feature (251)..(251): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtgcatttanacaatttgatggagataaaaatttcgcagactccgtgaagggccgattcaccatctccagagacccttccaaccatacgctgtatctcaaatgaacatggtanactagtagaagacacgactaacttattattgtgacgaaagtagtttcggttggtacgagtctatactaagtggtaggagttagggtcgtcgtcgactaccggtcggggaccgaacgggaacacgttcggtaccgtacccgttcctccctccgtaccgccctacccgaacccgaaccgggcccctacgttcccggttcccttcccccgtcggtacccctaccccgttaccctacccgaacgaccgtccctaacccg

SEQ ID NO: 43436 - DNA, 540 bp, Homo sapiens
  misc_feature: GYAE6OF02HVU59.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactgggagtgggtggcatttatacaatttgatggagataaaaaatttttacgcagactccgtgaagggccgattcaccatctccagagacccttccaaccatacgctgtatctccaaatgaacatggtgacagttgaagacacggcaacttattattgtgcgaaagattcgttggttcgagcatcaatgtgatagggtgctcgacacctggggccagggaacacgtggtcaccgtctcctcagcctccaccacgggcccatccggtcttccccctggccacccgtccctcccgaacgacgcctaacccg

SEQ ID NO: 43437 - DNA, 539 bp, Homo sapiens
  misc_feature: GYAE6OF02I6YP5.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagattcgttggttcgagcatcaatgtggatagggtgctcgacacctggggccagggaacactggtcaccgtctcctcagccctccaccaagggcccatccggtccttcccccgtggcccacccttccctcccgaacgtacgctacccg

SEQ ID NO: 43438 - DNA, 535 bp, Homo sapiens
  misc_feature: GYAE6OF02F3024.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagatttcgttggttcgagcatcaatgtggatagggtgctcgacacctggggccagggacacgtggtcaccgtctcctcagcctcaccaagggcccatccggtccttcccccgtggcccaccctcctccaacgacgcctacccg

SEQ ID NO: 43439 - DNA, 534 bp, Homo sapiens
  misc_feature: GYAE6OF02FOR2D.31.14.B03.1.454.CMB.1.raw
  modified_base (395)..(395): a, c, t, g, unknown or other
  misc_feature (395)..(395): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagnttcgttggttcgagcatcaatgtggatagggtgctcgacacctggggccaggggaacactgggtcaccgtctcctcagcctccaccaacgggcccatccggtccttcccccgnggccacccgtcctccaagcncacccg

SEQ ID NO: 43440 - DNA, 586 bp, Homo sapiens
  misc_feature: GYAE6OF02J0NZU.31.14.B03.1.454.CMB.1.raw
tcagcagtagacgtcacgaccggtgctcgatttagtgtgagtagtttagggacgtagagcttggttttcctcgttgcgtctttaagaggtagtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggccaagggactggagtgggtggcatttatacaatttgatggagataaaaatttacgcagactccgtgaaggccgattcaccatctccagagacccttcaaccataccgctgtactctccaaatcgaacatggtgacagttgaagacacggctaacttacttattgtacgacgaaagctttcgttaggttcgagtctatccaagtcgtaggtagtagggtcgactcgtacaccgttgggccagggtacacgtcggtacaccgtctccgtcgagtccctaccgaccaacgggccctagtccggtccctttcccccgtaggccctaccctcccgtaccgaacggtaccgacctaacccgg

SEQ ID NO: 43441 - DNA, 535 bp, Homo sapiens
  misc_feature: GYAE6OF02ISAWP.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaaacttattattgtgacgaaagattcgttggttcgagcatcaatgtggatagggtgctcgacactggggccagggacactggtcaccgtctcctcagcctccaccaagggcccaatccggtccttcccccgtggcctacccctcctccaacgcgcctacccg

SEQ ID NO: 43442 - DNA, 572 bp, Homo sapiens
  misc_feature: GYAE6OF02ICM0A.31.14.B03.1.454.CMB.1.raw
  modified_base (408)..(408): a, c, t, g, unknown or other
  misc_feature (408)..(408): n is a, c, g, or t
  modified_base (450)..(450): a, c, t, g, unknown or other
  misc_feature (450)..(450): n is a, c, g, or t
tcagcagtagacgtcacgaccggtgctcgatttagtgtgagtagtttgggctgagcgtggtttcgtcgttaggctcttttaagtaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgtgggggggggcatttatacaatttgatggagaataaaaattttacgcagactccgtgaagggccgattcaccatctccagagacccttccaaccatacgctgtatctaccaaatagaacatggtgacagttgaagacacggcaacttattatttgtgacgaaagtntttcgttggttcgagcagtcaatgtggatagggtgctcgacnccgtgggcctagggacacgtggcaccgtctcctcacgcctccaccgaacgggcccaagttccgggtccctttacccccgtggtaccccaccccgttccctacccgaacgcgccctaacccgg

SEQ ID NO: 43443 - DNA, 544 bp, Homo sapiens
  misc_feature: GYAE6OF02H8CM3.31.14.B03.1.454.CMB.1.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggctgagcggtggtttcgcgtaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggcaagggctggagtgggtgcatttanacaatttgatggagataaaaaattttacgcagactccgngaagggccattcaccatctccaganacccttcaaccatacgctgtanctccaaatgaacatggtganagttgaagcagacaacttattattgtgacgaaagtatttcgttggttcgagcatcaatgtggatagggtgctcgacacgtggggccaagggacacgtgggtcctaccgtctccncagtccctaccgaccaagggcccagtccgggtcctttccccccgnggccaccctcctaccaagcgcctacccg

SEQ ID NO: 43444 - DNA, 607 bp, Homo sapiens
  misc_feature: GYAE6OF02IPC7C.31.14.B03.1.454.CMB.1.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccgaggccccaggcaaggggactgggagtgggtggcatttanacaatttgatggagaataaaaaattttacgacagactcgtgaaggccgatcaccatctccagacacccttccaaccatacgctgtatctaccaaatgaacatggtagacaagttagaaagacaacggactaaactttattaatttgttgacgaaagtatttcggttaggtttcgagcacttacaaagttggtaggagtaaggggttcggcttcggaacacccggttgggggacccaaaggggaccacgttcgggtccaccgttccgtcctcgacgccctaccaccgtaacgggccctaggtccgtccctccccgtggcccaccccgttcctacccgagtaccgcctacccg

SEQ ID NO: 43445 - DNA, 524 bp, Homo sapiens
  misc_feature: GYAE6OF02INL09.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagattcgttgttcgagcatcaatgtggatagggtgctcgacaccgtgggccagggacacgtggtcaccgtctcctcagcctcaccacggccatcggtccttcccctgccaccctcctccaagcgctaccg

SEQ ID NO: 43446 - DNA, 562 bp, Homo sapiens
  misc_feature: GYAE6OF02JZJB3.31.14.B03.1.454.CMB.1.raw
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactgggagtgggtggcatttanacaatttgatggagataaaaattttacgcagactccgtgaagggccgattcaccatctccagacgacccttccaaccatacgctgtatctccaaatgaacatggtnacagttagaagacacggacaacttattattgtgacgaaagtattcgttggtcgagcatcaatgtggagtagggtgctcgacaccgtgggccagggaacacgtggtccaccgtctcctcacgccctccaccgaacgggccctagttaccggtcccttcccccgtaggccctaccccgtcccttaccgaacgtaccgcctacccg

SEQ ID NO: 43447 - DNA, 535 bp, Homo sapiens
  misc_feature: GYAE6OF02GW1P8.31.14.B03.1.454.CMB.1.raw
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaaacttattattgtgcgaaagnttcgttggttcgagcatcaatgtggatagggtgctcgacncctggggccagggaacactggtcaccgtctcctcacgcctccaccaagggccccatccggtcttcccccgtggccaccctcctccaacgcgctacccg

SEQ ID NO: 43448 - DNA, 540 bp, Homo sapiens
  misc_feature: GYAE6OF02FKIEY.31.14.B03.1.454.CMB.1.raw
  modified_base (448)..(448): a, c, t, g, unknown or other
  misc_feature (448)..(448): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttatacaatttgatggagataaaaattttacgcagactccgtgaagggccgattcaccatctccagagacccttccaaccatacgctgtatctccaaatgaacatggtgacagttgaagacacggcaacttattattgtgcgaaagatttcgtggttcgagcatcaatgtgatagggtgctcgacacgtgggccagggacnctggtcaccgtctcctcacgcctaccgaccaacgggcccagttccgggtccttccccccgtggtccacccctcctcccaacgcgtccacccg

SEQ ID NO: 43449 - DNA, 539 bp, Homo sapiens
  misc_feature: GYAE6OF02FPNVB.31.14.B03.1.454.CMB.1.raw
  modified_base (471)..(471): a, c, t, g, unknown or other
  misc_feature (471)..(471): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttcaaccatacgctgtatctccaaatgaacatggtgacagttgaagacacggcaacttattattgtgacgaaagtattcgttggttcgagcatcaatgtggatagggtgctcgacaccgtggggccagggacacgtggcaccgtctcctnacgcctaccaccgaacggcccatccggtccttcccccgtggccacccctcctcccaagacgctacccg

SEQ ID NO: 43450 - DNA, 523 bp, Homo sapiens
  misc_feature: GYAE6OF02JGR2L.31.14.B03.1.454.CMB.1.raw
  modified_base (517)..(517): a, c, t, g, unknown or other
  misc_feature (517)..(517): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaattttgatggagataaaaaattttacgcagactccgtgaagggccgattcaccatctccagagacccttccaaccatacgctgtatctccaaatgaacatgtgacagttgaagacacggcaacttattattgtgcgaaagattcgttggttcgagcatcaatgtggatagggtgctcgacacctgggccagggaacactggtcaccgtctcctcagcctcaccagggcccatcggtcttcccctggccaccctcctccagcnctaccg

SEQ ID NO: 43451 - DNA, 552 bp, Homo sapiens
  misc_feature: GYAE6OF02JGGE3.31.14.B03.1.454.CMB.1.raw
tcagcagtagacgtcacgaccggtgctcgatttagtgtgagtagtttgggtctgagctgggttttccttcgtttgctcttttaagtaggtgtccagtgtcaggtgcacctggtggaatctggggaggcgtggtccggcctgggggtcccgtgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagacccttccaaccatacgctgtatctccaaatgaacatggtgacagttgaagacacggcaattattatgtgcgaaagatttcgttggtcgagcatcaatgtggatagggtgctcgacaccgtggggccagggaacacgtggtacaccgttctcctcagccctccaaccgaagggccccaattccgggtcctttcccccgtggcctacccctcctcccaaggcgaccacccg

SEQ ID NO: 43452 - DNA, 542 bp, Homo sapiens
  misc_feature: GYAE6OF02GZ8ZI.31.14.B03.1.454.CMB.1.raw
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtgcatttanacaatttgatggagataaaaaattttacgcagactccgtgaagggccgattcaccatctccagagacccttcaaccatacgctgtatctccaaatgaacatggtgacagttgaagacacggcaacttatattgtgcgaaagattcgttggttcgagcatcaatgtggatagggtgctcgacacctgggccagggacacgtggtcacgtctcctcagccctccaccgaagggccccaattccggtccttcccccgtggccctaccccttcctcccgaacgacgcctaacccg

SEQ ID NO: 43453 - DNA, 564 bp, Homo sapiens
  misc_feature: GYAE6OF02GWH1X.31.14.B03.1.454.CMB.1.raw
  modified_base (422)..(422): a, c, t, g, unknown or other
  misc_feature (422)..(422): n is a, c, g, or t
tcagcagtagacgtcacgaccggtgctcgatttagtgtgagtagtttgggctgagcgtggtttcgtcgttgctctttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggtggcatttatacaattttgatggagataaaaaattttacgcagactccgtgaagggccgattcaccatctccagagacccttccaaccatacgctgtatctccaaatgaacatggtgacagttgaagacacggcaacttattattgtgcgaaagatttcgttggttcgagcatcaatgtggntagggtgctcgacaccgtggggccaggggacacgtggtcaccgtctcctcacgcccttccaccgaacggggcccacgttccgggtccctttccccccgtggaccctaccccttcccgttacccaacggtccgacctacccgg

SEQ ID NO: 43454 - DNA, 574 bp, Homo sapiens
  misc_feature: GYAE6OF02GPJ0X.31.14.B03.1.454.CMB.1.raw
tcagcagtagacgtcacgaccggtgctcgatttagtgtgagtagtttgggctgagcgtggtttcgtcgttagctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccagggccccaggcaagggctgggagtgggtggcatttatacaatttgatggagataaaaattttacgcagactccgtgaagggccgattcaccatctccagagaccccttccaaccatacgctgtatctaccaaatgaacatggtgactagttgaagacacggactaacttatttaattgtagacgaaagtatttcgtttggttacgagctatcaatgtggatagggtgctcgacaccggtgggaccgagggacacgtggtcaccgttctcctcgacgccctccaccgaacgggcccattccgggtccttccccccgttggaccctaccccgtcctacccaacggtaccgacctacccgg

SEQ ID NO: 43455 - DNA, 610 bp, Homo sapiens
  misc_feature: GYAE6OF02H4QRG.31.14.B03.1.454.CMB.1.raw
  modified_base (415)..(415): a, c, t, g, unknown or other
  misc_feature (415)..(415): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggacgtgaaggcgtgggtttcctcgttagactcttttaaggaggtgtccacgtgtcaggtgtcacctggtcggactctggggaggcgtggtccggcctgggggtccctgagacgtctccgtgtagccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagacccttccaaccatacgctgtatctccaaatgaacatggtgacagttgaagacacggactaactttattatttgtgacgaaagtntttcgttaggttccgagctatcaattggtggatagggtgcttcgacacccgtgggggcccaagggaaccacgtgggtccaccggtcctacctcgacgtccctccaacccgaacggggccccaagttcccgggtaccctttccccccgnggtaccccaccccttccccttacccgaaacgtccgccctaaccccgg

SEQ ID NO: 43456 - DNA, 521 bp, Homo sapiens
  misc_feature: GYAE6OF02HPBM3.31.14.B03.1.454.CMB.1.raw
  modified_base (442)..(442): a, c, t, g, unknown or other
  misc_feature (442)..(442): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagttagggttagggggagctacaacaggcaggtccacgggcagcaagatggtgttgcaggacccagggtcttacgatttctctgttgctctggatctctggtgcctacggggacatcgtgatgagccagtttccagactccctggctgtgtctctgggcgagagggccaccatcaaactgcaagtccagccagagtgttttattggcccacaataacaactacttagcttggtaccagcagaaagtaggacagcctcctaaaactcctgatttactgggcttctacccgggcatccggggttcctaaccgattcattggcagcgggtctggggacctatttcactctcaccatcagcagcctgcaggctgaagatgtggcagtttatactgtcagcaacnttatacttcttcgtcacttttcggcggtaggacctaaggtggagatacaaacgactgtggctgcacatctgtcttntac

SEQ ID NO: 43457 - DNA, 539 bp, Homo sapiens
  misc_feature: GYAE6OF02FJL6I.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttcaaccatacgctgtatctccaaatgaacatggtgacagttgaagacacggcaaacttattattgtgcgaaagatttcgttggttcgagcatcaatgtggatagggtggctcgacacctggggccagggaacacgtggtcaccgtctcctcagcctccaccaagggccccagtccggtcttcccccgtggccaccctcctcccaacgacgctacccg

SEQ ID NO: 43458 - DNA, 546 bp, Homo sapiens
  misc_feature: GYAE6OF02G8X81.31.14.B03.1.454.CMB.1.raw
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagacccttccaaccatacgctgtatctccaaatgaacatggtnacagttgaagacacggcaacttattattgtnacgaaagtntttcgttggttcgagcatacaatgtggatagggtgctcgacaccgtgggccaggacactggtcaccgtctcctcagccctcaccgaggcccctaagtccggtcttcccccgnggacccncccctcctacccaagacgcctacccgg

SEQ ID NO: 43459 - DNA, 562 bp, Homo sapiens
  misc_feature: GYAE6OF02HR20W.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtcctgagactctcctgtgccatgtctgcgtctgaattcatcctcaggcactatggcatgcactgggtccnccaggccccaggcaagggactggagtgggtggcatttanacaatttgatggagaataaaaattttacgcagactccgtgaaggccgattcaccatctccagagacccttccaaccatacgctgtactctaccaaatgaacatggtnacagttgaaagacaacggcaaacttattattgtagacgaaagaatttcggttggttcgagcaatcaaatgtggagtagggtgctcgacaccgtggggccaagggacactggtcaccgtctcctcacgcctccgaccgagggcccctagtccggtcccttcccccgtggtcccaccctcccttacccaacggtcgcctacccgg

SEQ ID NO: 43460 - DNA, 557 bp, Homo sapiens
  misc_feature: GYAE6OF02H5CO1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttcaaccatacgctgtatctccaaatgaacatggtagacagttgaagacacggcaactttattatttgtgacgaaagtatttcgtttggttcgagtcatcaattgtaggatagggtgctcgacaccgtggggccagggacacgtggtcaccgtctcctcagccctaccaccaacgggcccacgtccggtccttcccccgtggcccacccgtccctcccgaagccgacctaccccg

SEQ ID NO: 43461 - DNA, 546 bp, Homo sapiens
  misc_feature: GYAE6OF02GOQ7R.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaattttacgcagactcgtgaaggccgattcaccatctccagagacccttccaaccatacgctgtatctccaaatgaacatggtgacagttgaagacacggcaacttattattgtgcgaaagattcgttggttcgagcatcaatgtggatagggtgctcgacaccgtgggccagggacacgtggtcaccgtctcctcacgcctccaccgacgggcccagtccggtccttcccccgtggaccctacccgttccctacccgaagaccgcctacccg

SEQ ID NO: 43462 - DNA, 540 bp, Homo sapiens
  misc_feature: GYAE6OF02IVBUP.31.14.B03.1.454.CMB.1.raw
  modified_base (514)..(514): a, c, t, g, unknown or other
  misc_feature (514)..(514): n is a, c, g, or t
tcagcagtagacgtcacgaccggtgctcgatttagtgtgagtagtttgggctgagcgtgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcattttatacaatttgatggagataaaaaattttacgcagactccgtgaagggccgattcaccatctccagagacccttccaaccatacgctgtatctccaaatgaacatggtgacagttgaagacacggcaacttattattgtgacgaaagattcgttggttcgagcatcaatgtggatagggtgctcgacaccgtgggccagggaacacgtaggtcaccgtctcctcacgcctccaccaacgggcccatccggtcttcccccgnggccaccctcctccaagcgcctaccg

SEQ ID NO: 43463 - DNA, 564 bp, Homo sapiens
  misc_feature: GYAE6OF02IRB7K.31.14.B03.1.454.CMB.1.raw
  modified_base (354)..(354): a, c, t, g, unknown or other
  misc_feature (354)..(354): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaaggccgattcaccatctccagagacccttccaaccatacgctgtatctcaaatgaacatggtnacagttgaagacacggcaacttattattgtgcgaaagattcgttggtcgagcatcaatgtggatagggtgctcgacaccgtggggccagggaacacgtggtcaccgtctcctcacgtccctccaccgaacgggcccctaagtcccgggttaccttccccccgtgggacccctacccgttcccctacccgaaacggtccgacctaccccgg

SEQ ID NO: 43464 - DNA, 792 bp, Homo sapiens
  misc_feature: GYAE6OF02J3X4U.31.14.B03.1.454.CMB.1.raw
  modified_base (167)..(167): a, c, t, g, unknown or other
  misc_feature (167)..(167): n is a, c, g, or t
  modified_base (185)..(185): a, c, t, g, unknown or other
  misc_feature (185)..(185): n is a, c, g, or t
tcagcagtagacgtcacgaccggtgctcgatttagtgtgagtagttgggctgagctgggtttcctcgttgctctttaagaggtgtccagtgtcaggtgcaccgtggtggaatcgtggggagcgtggtccggccgtgggggtcctgagctctcctgtcgaccatgtcngcgtactgattcactccncgaggcaacgtgtcggctagtcgaccgtcggttcgggcccaccgaccgggaccccgtagggaccggtaacggggtcgtggggacggtgggggtacaccttaatttaacgtaacgttaagtttaggaagtaaggtaaagttaaaaactttaaaacgttacggacgtaacggtacccgtacggtaacggacggtacctacgtaccacgacttaccacgtaccgtaacctaccctacaacctagactctacgtactacaacgtaacgacgtacgtagtcgacgtaacgtaaggtacgaacgtactaacgtactttagtttagtagtacgtagaacgtttaagtcgttttcggtaggtaacgcgtagtaccgttaggtaggttcggtaggttaacgggtcggggtactccctaaccggggaccgttaccggggacgggaacgtaaccgggtaccctacgttacccggtcccttaccggacctacccggacgtaccccggaccccgtacggaaccccggtaccgggtcccctaccgttccccgttccccgttaccccggacgttacccctccccggaccttaaagggcccgttaccccgtacggtacccggg

SEQ ID NO: 43465 - DNA, 585 bp, Homo sapiens
  misc_feature: GYAE6OF02G4NZ9.31.14.B03.1.454.CMB.1.raw
  modified_base (412)..(412): a, c, t, g, unknown or other
  misc_feature (412)..(412): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggctgagcgtgggtttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtggggtggcatttatacaatttgatggagaattaaaaaattttacgcagactccgtgaagggccgattcaccatctccagacgaccccttccaaccatacgctgtatctaccaaatgaacatggtagactagttgaaagacacggacaactttattattgtagacgaaaagtntttcggttggttcgagcatcaatgtggatgggtgctcgacaccgtggggaccagggaacacgtggtcaccgttctcctcgacgccctaccaccgaaccgggcccctaagttcccggtcccgtttcccccgnggacccctaccccgtccctaccgaacgtaccgccctacccgg

SEQ ID NO: 43466 - DNA, 581 bp, Homo sapiens
  misc_feature: GYAE6OF02IJZ8O.31.14.B03.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (491)..(491): a, c, t, g, unknown or other
  misc_feature (491)..(491): n is a, c, g, or t
tcagcagtagacgtcacgaccggtgctcgatttagtgtgagtagtttgggctgagcgtggtttctcgttagctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtgctatttanacaatttgatggagataaaaatttacgcagactccgtgaaggccgattcaccatctccagacgacccttccaaccatacgctagtatctaccaaatcgaacatggtgactagttagaagacacggactaaacttattattgtgacgaaagtatttcgttggtacgtagcgatcaatgtggtagtagggtgcgtcgacgaccgtgggaccgagggaacacgtcggtcctaccgtccgtcncgacgacctcccaaccgaccggccctacgtaccgtcccgttccccgtccggtcccaccccgttcctacccggaactaccgacctacccgg

SEQ ID NO: 43467 - DNA, 566 bp, Homo sapiens
  misc_feature: GYAE6OF02HA5WS.31.14.B03.1.454.CMB.1.raw
  modified_base (246)..(246): a, c, t, g, unknown or other
  misc_feature (246)..(246): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggctgagcgtggtttcgcgtagctctttaagaggtgtcagtgtcaggtgcacctggtggaatctgggggaggcgtggtccggcctgggggtccctgagactctcctgtgccatgtctgcgtctgaattcatcctcaggcactatggcatgcactgggtccgcaggccccaggcaagggactggagtgggtgcatttanacaatttgatggagataaaaatttcgcagactcgtgaagggccgattcaccatctccagacgacccttcaaccatacgctgtactctaccaaatgaacatggtagactagttgaaagacacggtactaaactttatatttgtgacgtaaaagtntttcgttggttcgagcatacaatgtaggatagggtgctacgacaccgtggggccaagggaccacgtggtaccaccgttcgtacctcgacgcctacccgaaccgaacgggtcccaagttccggtcccttacccccgtggcctaccctcctacaacgcgcctacccgg

SEQ ID NO: 43468 - DNA, 536 bp, Homo sapiens
  misc_feature: GYAE6OF02GLXQD.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaattttacgcagactccgtgaaggccgattcaccatctccagacgacccttccaaccatacgctgtatctccaaatgaacatggtnacagttgaagacacggcaacttattattgtgacgaaagntttcgttggttcgagcatcaatgtgatagggtgctgacncgtgggccagggacagtggtcacgtctctcagcctcaccgaggccccagtccggtccttcccccgtggccctacccctcctaccgaacgtacgcctacccgg

SEQ ID NO: 43469 - DNA, 576 bp, Homo sapiens
  misc_feature: GYAE6OF02GT7GS.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaaattttacgcagactccgtgaagggccgattcaccatctccagacgacccttccaaccatacgctgtatctaccaaatgaacatggtgacagttagaagacacggcaaactttattatttgtagacgtaaagtatttcggtttgggttcgagcatacaatgtaggatagggtgctcgacaccgtggggccagggacacgtggtcaccgtctcctcacgccctaccaccaacggggccccaagttcccgggtcccttcccccgtggccctaccccgtccctacccgaacgaccgcctacccgg

SEQ ID NO: 43470 - DNA, 626 bp, Homo sapiens
  misc_feature: GYAE6OF02I0FZ8.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanacaatttgatggagaataaaaattttacgacagactcgtgaaggccgattcacatctccagacacccttccaaccataccgactgtatctaccaaatgaacatggtgacagttgaagacacggactaacttaattattgtagacgaaagtatttcgttaggttcgagctaatactaattgtaggtatagggtgctacgacaccggtggggccaaggggaaccacgtggtaccacccggttctacccgtcgaccgtccctacccgaaccgaaccggggtccccctaacggttcccgggttacccctttcccccccggtacggtaccccgtaacccccgttcccctacccgaaaccggtaccgacccttacccccgg

SEQ ID NO: 43471 - DNA, 537 bp, Homo sapiens
  misc_feature: GYAE6OF02IF5G7.31.14.B03.1.454.CMB.1.raw
  modified_base (469)..(469): a, c, t, g, unknown or other
  misc_feature (469)..(469): n is a, c, g, or t
  modified_base (508)..(508): a, c, t, g, unknown or other
  misc_feature (508)..(508): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtgcatttatacaatttgatggagataaaaaattttacgcagactccgtgaagggccgaattcaccatctccagagacccttccaaccatacgctgtatctccaaatgaacatggtgacagttgaagacacggcaacttattattgtgacgaaagattcgttggttcgagcatcaatgtagatagggtgctcgacaccgtggggccagggacactggtcaccgtctccncacgcctccgaccaacgggcccatccggtccttcccccnggccacccgtccctaccgaagcgcacccg

SEQ ID NO: 43472 - DNA, 709 bp, Homo sapiens
  misc_feature: GYAE6OF02JZRA8.31.14.B03.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (609)..(609): a, c, t, g, unknown or other
  misc_feature (609)..(609): n is a, c, g, or t
  modified_base (663)..(663): a, c, t, g, unknown or other
  misc_feature (663)..(663): n is a, c, g, or t
tcagcagtagacgtcacgaccggtgctcgatttagtgtgagtagtttgggtcgtgagctgggttttcgttcgttgtctctttaagtaggtgtccagtgtcaggtgcacctggtggaatctggggagggcggtggtccggccgtggggggtcccgtgaggactctcctgtgccatgtctgcgtctgaattcatcctcaggcactatggcatgcactgggtccgccaggccccaggcaagggactggagtgggtgcatttatacaattgatggaagactaaaaattttacgcaagtactccggtgaaggggccagttcaccatctccaagacaccccttccaaaccntaacnctgttatcctcaaaatgaaaccattgggtacgactaagtttggaaaacgacacccgggacaaaacttttattaatttgtaggacgaaaacgtaaagttttccggttttgggtaccgaggtcaattacaaagttgtacgggtaagtacggggttagggcccttacggaaccaaccccggtttggggggaccccgtaaggggaaaccgttaaacttcggggttaccaaacccgttccctttccgacccgaagtttcccccncccaaccggtaaaacggggccccaacggttttccgtacccggttttcccccccnggggacctacccccttcctaacccgaaagtacggccctaaaccccg

SEQ ID NO: 43473 - DNA, 599 bp, Homo sapiens
  misc_feature: GYAE6OF02I8FY2.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgattggagaataaaaaattttacgcagactccgtgaagggccgattcaccatctccagacgacccttccaaccatacgctgtatctaccaaatgaacatggtgacagttgaagacacggacaacttattactttgtgacgaaagtattacgttgggtttacgagctattcaattggtgggtagtaggggtggcgtaccgacgaccgttcggggaccgaggggaaccacgtcgggtccacccgttctacctcacgccctaccaccgaaccgggccctaacgttccggtacccttcccccgtcgtccaccccctccctacccaaggtccacctaccccgg

SEQ ID NO: 43474 - DNA, 607 bp, Homo sapiens
  misc_feature: GYAE6OF02IDLBE.31.14.B03.1.454.CMB.1.raw
  modified_base (214)..(214): a, c, t, g, unknown or other
  misc_feature (214)..(214): n is a, c, g, or t
  modified_base (360)..(360): a, c, t, g, unknown or other
  misc_feature (360)..(360): n is a, c, g, or t
  modified_base (595)..(595): a, c, t, g, unknown or other
  misc_feature (595)..(595): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttatacaatttgatggagaataaaaattttacgcagactccgtgaaggccgattcaccatctccagacgacccttcaaccatacgctgtatctaccaaatgaacatggtnacagttgaaagacacggactaaacgttattaatttgtagacgtaaagagtttcgttggttcgagtcatacaatgtaggagtaggggtgtcctacgacaccgtggggacccagggaaccacgtcggtaccaccgttccgtacctcgacgccctaccgacccgaacgggcccctaagttcccgggttacccttccccccgttggccccttaacccgtccccttaccgaacggtaccncccgtaacccgg

SEQ ID NO: 43475 - DNA, 542 bp, Homo sapiens
  misc_feature: GYAE6OF02I61WF.31.14.B03.1.454.CMB.1.raw
  modified_base (535)..(535): a, c, t, g, unknown or other
  misc_feature (535)..(535): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagattcgttggttcgagcatcaatgtggatagggtgctcgacaccgtggggccagggaacacgtggtcaccgtctccctcacgccctccaccgaacgggcccagtccggtccttcccctggccaccctcctccaacgacnctacccg

SEQ ID NO: 43476 - DNA, 573 bp, Homo sapiens
  misc_feature: GYAE6OF02H60QY.31.14.B03.1.454.CMB.1.raw
  modified_base (255)..(255): a, c, t, g, unknown or other
  misc_feature (255)..(255): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaatttcatcctcaggcactatggcatgcactgggtccgccaggccccaggcaagggactgggagtgggtggcatttanacaattttgatggagaataaaaaattttacgcagactccgtgaagggccgattcaccatctccagagacccttccaaccatacgctgtatctaccaaatgaacatggtgacagttgaagacaacggacaacttattatttgtgacgaaagtattcgtttggttcgagcatcaatggtggagtagggtgctcgacaccgtggggaccagggacacgtggtcaccgtctcctcacgccctaccaccgaacgggccccacgtccgggtccctttcccccgnggccctaccccgtccctacccgaacgtaccgcctaccccg

SEQ ID NO: 43477 - DNA, 574 bp, Homo sapiens
  misc_feature: GYAE6OF02F1OU0.31.14.B03.1.454.CMB.1.raw
  modified_base (404)..(404): a, c, t, g, unknown or other
  misc_feature (404)..(404): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaaattttacgcagactccgtgaagggccgattcaccatctccagacgaccccttccaaccatacgctgtatctccaaatgaacatggtgacagttgaagacacggacaactttattattgtgacgaaagtntttacggttggttcagcatcaatgtggattaggggtgcgtgacaccgtggggaccagggaacacgtggtcaccgtctccgtcacgccctaccaaccgaacggggccccaagttccggtacccttccccccgtggccctaccccgtcctacccaacggtacgccctacccg

SEQ ID NO: 43478 - DNA, 561 bp, Homo sapiens
  misc_feature: GYAE6OF02IYZKP.31.14.B03.1.454.CMB.1.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
tcagcagtagacgtcacgaccggtgctcgatttagtgtgagtagtttgggctgagcgtggtttccgtcgttaggctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacatttgatggagataaaaatttacgnagactcgtgaaggcgattcacatctccagagacccttccaaccatacgctgtatctcaatgaacatgtgacagttgaagacacggactaacttattattgtgacgaaagtactttcgttggttcgagtcatctaatgtaggtatagggtgctcgacaccgtggggccagggacacgtggtcaccgttctcctcgacgtcctaccacgacgggccctagttcccggttccgttacccccgtggtcccctacccgtccctacccgaacgtaccgcctacccg

SEQ ID NO: 43479 - DNA, 948 bp, Homo sapiens
  misc_feature: GYAE6OF02H7PYD.31.14.B03.1.454.CMB.1.raw
tcagcagtagacgtcacgaccggtgctcgatttagtgtgagtagtttgggcgttggacgctcgggttttccgtcgttcgctcttttaagtaggtgtcctagtgtcaggtgcgacctggtggaatctggggaggcgtggtccggcctgggggtcctgtaggactctcctgtgtccatgtctgtacgtctgaattcatccgtcaggctacgtagtggccgaatcgtcacgtgggtcccgccggacggccccgaggcaagggctgggagtcgggtggcctatttagtacgtaacttttgacttggacgtaacttaaaaaagttttcggacctaagtaaccgttcccggtacgaaaggggtacccgaagttacccggaaaccgacgttaccgtaccgaaggtacggtaaccccttaccgtaaacccgtaattaaccggaccttaggtaactcctaccaaaagttacgaaacccgtagttacggtacggtaacgtaagggtttacgaaacgtccgaaccggtactaaaccgttttaagttaagtttacggtacgtaaaccggtaaaaggttaacgtttaccgggtttaggtttaccggaacggttactaacgttaaccgtaaaggttacggttacggggtaaacgtttaacgggggtacggttcccgtttaaccggaacccggtaaaccccgggttacggggggaaccccgtaaacggggggttaaccctaaccggttttaccgggttaccccgttaaacccgggtttccccgttaaacccggtaccgggttaaccgtacccgttaccccgaaacccggtaaacccgggggtccccgttaaccggtttacccggggttcccccgttttacccccccggtaggggtaccccccgtaacccccggtcccccggttaaccccgtaacgggttaccccggtacccttaacccccggg

SEQ ID NO: 43480 - DNA, 582 bp, Homo sapiens
  misc_feature: GYAE6OF02IDO3V.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaagggactggagtgggtggcatttanacaatttgatggagataaaaattttacgcagactccgtgaagggccgattcaccatctccagagaccccttccaaccatacgctgtatctaccaaatgaacatggtagacagttagaagacaacggctaacttattatttgtgacgaaagtattcgttggttcgagtcaatcaatgtaggagttagggtggctcgacaccgtggggccagggacacgtggtaccaccgttctccgtcacgtccctaccaccgaacgggccccacgttcccgggtccctttcccccgcggtaccctaccccgtcccttacccgaacgtcgaccctacccgg

SEQ ID NO: 43481 - DNA, 554 bp, Homo sapiens
  misc_feature: GYAE6OF02F255G.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactgggagtgggtggcatttatacaatttgatggagataaaaaattttacgacagactccgtgaagggccgattcaccatctccagagacccttccaaccatacgctgtatctccaaatgaacatggtgacagttgaagacacggcaacttattattgtgacgaaagattcgttggttcgagcatcaatgtggatagggtgctcgacaccgtggggccagggaacacgtggtccaccgtctcctcacgcctaccaccgaacgggccccagtccggtccttcccccgtggccctacccctcctacccaacggtacgcctacccg

SEQ ID NO: 43482 - DNA, 782 bp, Homo sapiens
  misc_feature: GYAE6OF02GZ4TN.31.14.B03.1.454.CMB.1.raw
tcagcagtagacgtcacgaccggtgctcgatttagtgtgagtagttgggctgagctggggtttcctcgttgctcttttaaggaggtagtccagtgtctagggtcgcaccgtacggtggaagtactcggggaggcggtggtccggccttgggggtccctgacgactctcctgtgccactggtacctgcgtctagaattcatcctcaggcactatggccatcgcactgggtccgccacggccccgaggcaaggggacctcgggacgtcgggtggcagtttactacgaatttgattggtagaactaaaaattttacgcctaggtactccgtagaagggaccgaacttcgaccagtcctcccaggacgtaccccttccaacctataacgtcgttgtactccttacccaaacttcggaaaccagtggggttactacccgtaagttcggaaacggtaccaaacgggtcaaaccgtttagtttacgtttcgttagggaccgtaaaaggtacttttccggttacgggtttaccggtacgtaccaattcaaagttcggtagggacgttagggggtcggtaccgttacggaccgaccgttcgggggacccttaagggggtaacctacgtttagggttacctacccggttcgtacccgtacacggtacccttacccgaacccgtaaccggggtcccctaaccggttcccgggttaccctttccccccggtagggtaccccttaccccggttccccgtacccggtaaaccggtaccggtacccgtaaccccggg

SEQ ID NO: 43483 - DNA, 586 bp, Homo sapiens
  misc_feature: GYAE6OF02HXKQC.31.14.B03.1.454.CMB.1.raw
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggcatttatacaatttgatggaagaataaaaaattttacgcagactccgtgaaggccgattcaccatctccagacgacccttccaaccatacgctgtatctaccaaatgaacatggtnacagttgaagacaacggacaactttaattattgtagacgaaaagtatttcgttaggttcgagtcatcaatgtggatagggtagctacgaccaccgtggggaccaagggacactgggtcacccggttctcctcgacgccctaccacccgaacgggcccctaagtcccggttcctttccccccgtggaccctaccccgttcccacccaacggacgccctaaccccgg

SEQ ID NO: 43484 - DNA, 551 bp, Homo sapiens
  misc_feature: GYAE6OF02G22DN.31.14.B03.1.454.CMB.1.raw
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagaccccttccaaccatacgctgtatctaccaaatgaacatggtnacagttagaagacacggacaacttattattgtgacgaaagtattcgttggttcgagcatcaatgtggatagggtgctcgacaccgtggggccagggaacacgtggtcaccgttctcctcacgccctccaccaacgggcccagtccggtccttcccccgtggcccaccctcctacccaacgcgcctacccg

SEQ ID NO: 43485 - DNA, 553 bp, Homo sapiens
  misc_feature: GYAE6OF02IMCHC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgacgaaagtattcgttggttcgagcatcaatgtggatagggtgctcgacaccgtggggccagggacagtcggtcaccgttctcctcacgccctccaccgaacgggcccagtcccggtccttcccccgtggccctacccctccctccaacggacgcctacccg

SEQ ID NO: 43486 - DNA, 641 bp, Homo sapiens
  misc_feature: GYAE6OF02JTTLR.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttatacaatttgatggagaataaaaatttacgacagactccgtgaagggccgattcaccatctaccagacgacccttaccaaccatacgctgtactctaccaaatcgaaacagtggtacgaactagttagaaacggtaccgaacggacctaaactttattaacgtttggtagacgtaaagtatttcgttaggttcgagacatactaatgtaggagtagggtgtcgtacgacgaccgttagggaccgacggaaccgacgtggtaccgtaccgtcctccgtaccgacgtacccgtaccgaccgtaaccgggccccgtacgtacccggttcccgttacccccgtcggtccccgtacccgtaccccgtaccgtaaccgtacgaccctaaccccgg

SEQ ID NO: 43487 - DNA, 548 bp, Homo sapiens
  misc_feature: GYAE6OF02HILP5.31.14.B03.1.454.CMB.1.raw
  modified_base (252)..(252): a, c, t, g, unknown or other
  misc_feature (252)..(252): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttanacaatttgatggagaataaaaaattttacgcagactccgtgaaggccgattcaccatctccagacgacccttccaaccatacgctagtatctaccaaatgaacatggtagacagttagaagacacggactaaacttattattgtagacgaaagtattcgttgtcgagcatcaatgtggatagggtgcgtcgacaccgtggggaccagggaacacgtggtcaccgttctcctcacgcctccaccgacggcccagtccggtccttccccgngcccaccctcctaccaacgcgctaccg

SEQ ID NO: 43488 - DNA, 564 bp, Homo sapiens
  misc_feature: GYAE6OF02HAR9Y.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtgcatttanacaatttgatggagaataaaaaattttacgcagactccgtgaagggccgattcaccatctccagacgacccttccaaccatacgctgtatctaccaaatgaacatggtagactagttagaaagacacggacaaacttattattgtgacgaaagtatttcggttggttacgagctaatcaattgtggaataggggtgctcgacaccgtggggccaagggacacgtggccaccgtctcctcacgccctccaccgacgggcccagtccggtcccttccccgtggcccacccttccaccgaacgcgcctacccgg

SEQ ID NO: 43489 - DNA, 541 bp, Homo sapiens
  misc_feature: GYAE6OF02GXXPV.31.14.B03.1.454.CMB.1.raw
  modified_base (255)..(255): a, c, t, g, unknown or other
  misc_feature (255)..(255): n is a, c, g, or t
  modified_base (401)..(401): a, c, t, g, unknown or other
  misc_feature (401)..(401): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaagggactgggagtgggtggcatttanacaatttgatggagaataaaaaattttacgcagactccgtgaagggccgattcaccatctccagagacccttccaaccatacgctgtatctccaaatgaacatggtgacagttgaagacacggcaacttattattgtgacgaaagntttcgttggttcgagcatcaatgtggatagggtgctcgacaccgtgggccagggacagtggtcaccgtctcctcacgcctccacaacgggcccagtccggtccttcccccgtggcccaccctcctccaagacgctacccg

SEQ ID NO: 43490 - DNA, 561 bp, Homo sapiens
  misc_feature: GYAE6OF02HO4UO.31.14.B03.1.454.CMB.1.raw
  modified_base (214)..(214): a, c, t, g, unknown or other
  misc_feature (214)..(214): n is a, c, g, or t
  modified_base (360)..(360): a, c, t, g, unknown or other
  misc_feature (360)..(360): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagaataaaaattttacgcagactccgtgaagggccattcaccatctccagagaccccttccaaccatacgctgtatctaccaaatgaacatggtnacagttagaagacacggctaacttattattgtagacgaaagtatttcgttggttcgagcatcaatgtaggaattaggggtgctcgacaccgtggggaccagggaacacgtggtcaccgtctcctcacgcctaccaccgaacgggcccacgtccggtccttcccccgtggcccacccgtccctaccaacgaccgcctacccg

SEQ ID NO: 43491 - DNA, 678 bp, Homo sapiens
  misc_feature: GYAE6OF02F0BKV.31.14.B03.1.454.CMB.1.raw
  modified_base (348)..(348): a, c, t, g, unknown or other
  misc_feature (348)..(348): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaagggccgattcaccatctccagagacccttccaaccatacgctgtactctacaatnaacagtggtgactagttagaagacgacggactaacttattattgtgacgaaagtagtttcgttggttacgagctatacaagttggtaggtagttaggggtcggtccgtacgaaccgtacccgggttcgggggacccgaaggggaaccacgttcgggtaccctacccggttccttaccccgtacgaccgtccccttaccccgaacccggtaaacccgggggtccccctaacgggtttccccgggttaccccccttttcccccccggtacgggacccccttaacccccgttccccgtaacccgaaacggtacccggacccttaacccccggg

SEQ ID NO: 43492 - DNA, 541 bp, Homo sapiens
  misc_feature: GYAE6OF02F5QT0.31.14.B03.1.454.CMB.1.raw
  modified_base (399)..(399): a, c, t, g, unknown or other
  misc_feature (399)..(399): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccattcaccatctccagacgacccttccaaccatacgctgtatctccaaatgaacatggtgacagttgaagacacggcaacttattattgtgacgaaagtnttcgttggttcgagcatcaatgtggatagggtgctcgacaccgtggggccagggacacgtggtcaccgtctcctcacgccctcaccaagggccccagtccggtccttccccgtggccaccctcctaccaacgcgcctacccg

SEQ ID NO: 43493 - DNA, 566 bp, Homo sapiens
  misc_feature: GYAE6OF02FFZUV.31.14.B03.1.454.CMB.1.raw
  modified_base (253)..(253): a, c, t, g, unknown or other
  misc_feature (253)..(253): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaattttcgcagactccgtgaagggccattcaccatctccagagaccctttccaaccatacgctgtactctaccaaatgaactatggtagacagttgaagacacggactaacttattattgtagacgaaagtatttcgttggttcgagcatcaatgtaggataggggtgctcgacaccgtgggccagggacacgtggtccaccgtctcctcacgcctccaccgaacgggccccacgtcccggtccctttcccccgnggccctaccccgtcctacccgaagtacgccctacccgg

SEQ ID NO: 43494 - DNA, 547 bp, Homo sapiens
  misc_feature: GYAE6OF02G5LP3.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (358)..(358): a, c, t, g, unknown or other
  misc_feature (358)..(358): n is a, c, g, or t
  modified_base (472)..(472): a, c, t, g, unknown or other
  misc_feature (472)..(472): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaaattttacgcagactccgtgaagggccgattcaccatctccagagacccttccaaccatacgctgtatctccaaatgaacatggtnacagttgaagacacggcaacttattattgtgacgaaagtattcgttggttacgagcatcaatgtaggatagggtgctcgacaccgtggggccagggacacgtggtacaccgtcnctcagccctaccaccgaacgggccccaagtccggtccttcccccnggcccaccctcctacccaagcacctacccg

SEQ ID NO: 43495 - DNA, 569 bp, Homo sapiens
  misc_feature: GYAE6OF02I50BP.31.14.B03.1.454.CMB.1.raw
  modified_base (460)..(460): a, c, t, g, unknown or other
  misc_feature (460)..(460): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggagaattaaaaattttacgcagactccgtaggaagggccgtattcaccatctccagacgaccccttaccaaccataccgctgtatctaccaaatgaacatggtgacagttagaacgacacggcaaactttattattgtagacgtaaagtatttcggttggttcgagcatacaagtgtggatagggtgctcgacncgtgggccagggacacgtggtcacgtctcctcacgcctaccaccgaacgggccctaagtccggttcccttcccccgtggcccnccctcccaccgaacgccacctacccg

SEQ ID NO: 43496 - DNA, 558 bp, Homo sapiens
  misc_feature: GYAE6OF02GIWLN.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaaattttacgcagactccgtagaagggccgattcaccatctccagacgacccttccaaccatacgctgtatctaccaaatgaacatggtagacagttagaagacacggcaacttattattgtgacgaaagtattcgttggttcgagcatcaagtgtggatagggtgctcgacaccgtggggccagggacacgtggtcaccgtctcctcacgccctaccaccaacgggcccagttccggtcccttcccccgtggcccacccctccctaccgaacgacgcctacccg

SEQ ID NO: 43497 - DNA, 623 bp, Homo sapiens
  misc_feature: GYAE6OF02GYSW2.31.14.B03.1.454.CMB.1.raw
  modified_base (400)..(400): a, c, t, g, unknown or other
  misc_feature (400)..(400): n is a, c, g, or t
tcagcagtagacgtcacgaccggtgctcgatttagtgtgagtagtttggggtcgtgagctacgggttttcctcgttgctccttttaagaggtgtacccagtgtcaggtgcacctggtggaatctgggggaggcggtggtccgggccgtggggggtcccctgagtacgtcgtcctgtgccatgtctgccgtctcgaattcatcctcaggcactatggcgatgcactgggtccgccagggcccccaggcaaggggactgggacgtggggtggacgtattttatacgaattttgattcggagtattaaaaaattttacgcaagacgtccgtgaacgggccgattcaccgatactccagacgacccttccaaccgatacgctacgtatctcaatgaacatggtnacagttagaacgacgacggcaacttattattgtacgacgaaagtctttcgttaggtttacgagcactacaatggtagtagtaggggtagctcgacaccgtggggaccagggacacgtcggtccaccgttctctacgacgcctccaccgaacgggccctacgtccggtaccttccccccgtaggcccctacccgtcccgtaccctaacggaccgtcctacccgg

SEQ ID NO: 43498 - DNA, 532 bp, Homo sapiens
  misc_feature: GYAE6OF02G3SVR.31.14.B03.1.454.CMB.1.raw
  modified_base (474)..(474): a, c, t, g, unknown or other
  misc_feature (474)..(474): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagaccccttccaaccatacgctgtatctccaaatgaaacatggtgacagttgaagacacggacaacttattattgtgcgaaagatttcgttggttcgagcatcaatgtggatagggtgctcgacacctggggccagggacactggtcaccgtctccncacgcctccacacggcccatcggtcctccccgtgcccaccctccaccacgcgctaccg

SEQ ID NO: 43499 - DNA, 580 bp, Homo sapiens
  misc_feature: GYAE6OF02H7TH4.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (360)..(360): a, c, t, g, unknown or other
  misc_feature (360)..(360): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaattttacgcagactccgtgaaggcgattcaccatctccagacaccccttccaaccatacgctgtactctaccaaatgaacatggtanacagttgaaagaccacgactaactttattatttgtgacgtaaagtatttcggtttggttcgagctatacaattggtaggagttaggggtgcgttacgaccaccgttgggggccaaggggaacacgtcggtacaccgtctcctcacgccctaccaaccgaacgggcccagtcccgtccttcccccgnggcccaccccgtcctacccgaagtccgctacccg

SEQ ID NO: 43500 - DNA, 569 bp, Homo sapiens
  misc_feature: GYAE6OF02HASHI.31.14.B03.1.454.CMB.1.raw
  modified_base (253)..(253): a, c, t, g, unknown or other
  misc_feature (253)..(253): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagagaccccttccaaccatacgctgtatctaccaaatgaacatggtnacagttagaagacacggactaacttattatttgtagacgaaagtatttcgttggttcgagcatcaatgtggatagggtgctcgacaccgtgggccgagggaacacgtggtaccaccgtctcctcacgccctaccaaccgacgggccctacgtccgggttcccttcccccgtgtacccaccccttccctacccgaacgcgccctacccg

SEQ ID NO: 43501 - DNA, 607 bp, Homo sapiens
  misc_feature: GYAE6OF02G6W7J.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggctatttanacaatttgatggagataaaaatttacgnagactcgtgaaggcgattcaccatctccagacgacccttcaaccatacgctagtatctcaaatgaacatggtnacagttgaagacacggacaacttattatttagtgacgtaaaagtatttcggttggttacgagtacatacaagttgtggaagtaggggtcgctacggacaccgtggggaccaagggtaacacgttggtaccacccgttctccgtacgacgtacccttcccgaaccggaacgggcccctacgttccgggttccccttacccccgtcggacccttcccccgtaccctacccgaacggtaccgtcctaaccccgg

SEQ ID NO: 43502 - DNA, 682 bp, Homo sapiens
  misc_feature: GYAE6OF02IIK17.31.14.B03.1.454.CMB.1.raw
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctgagactctcctgtgccatgtctgcgtctgaattcatcctcaggcactatggcatgcacgtgggtccgccagggccccagggcaagggactgggagtgggtggctatttatacaatttgatggagaataaaaattttacgcagactccgtgaagggccgattcacatctcagagaccctcaaccatacgctgtatctaccaaatgaacatggtnacagtgaaagacacgacaaacttatttaattgtagacgaaagtacgtttacgttggttacgtagacctaataccaaagttggtagggaagttaagggggttcggccgttaccggacgtaacccggttggggggaccctaagggggaaaccacgttcgggtacctaacccgggttccttacccgtccgaacgtccccttaccccgaaccgtaaaccggggtccccctaagtttccccggggttacccctttaccccccccgtggggacccccttaaccccccgtccccgtttacccgaaaacggtaccgcccgtaaccccgg

SEQ ID NO: 43503 - DNA, 559 bp, Homo sapiens
  misc_feature: GYAE6OF02IVNDV.31.14.B03.1.454.CMB.1.raw
  modified_base (460)..(460): a, c, t, g, unknown or other
  misc_feature (460)..(460): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaagggccgattcaccatctccagacgacccttccaaccataccgctgtatctaccaaatgaacatggtgacagttagaagacacggacaacttattattgtgacgaaagtatttcgttggttcgagcatcaatgtggatagggtgctcgacactggggccagggaacncgtggtcacccgtctcctcacgcctaccaccgaacgggccctagtcccggtccttcccccgtggccctaccccgtcctacccaacggacgcctacccgg

SEQ ID NO: 43504 - DNA, 526 bp, Homo sapiens
  misc_feature: GYAE6OF02GT25U.31.14.B03.1.454.CMB.1.raw
  modified_base (253)..(253): a, c, t, g, unknown or other
  misc_feature (253)..(253): n is a, c, g, or t
  modified_base (330)..(330): a, c, t, g, unknown or other
  misc_feature (330)..(330): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaattttacgcagactccgtgaagggccgattcaccatctccagagacccttccaaccntacgctgtatctccaaatgaacatggtgacagttgaatacacggcaacttattattgtgcgaaagtattcgttggttcgagcatcaatgtggatagggtgctcgacaccgtggggccagggaacacgtggtcaccgtctcctcagcctccaccaggcccatcggtcctcccngccnccctccnccacgcnctaccg

SEQ ID NO: 43505 - DNA, 557 bp, Homo sapiens
  misc_feature: GYAE6OF02HT0QG.31.14.B03.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtagacgaaagatttcgttggttcgancatcaatgtggatagggtgctgacaccgtggggccagggacacgtggtacaccgtctctcacgccctccaccacgggccccagttccggtcctttccccccgtgggccctaccccgtccgtacccaacggcgaccctacccgg

SEQ ID NO: 43506 - DNA, 679 bp, Homo sapiens
  misc_feature: GYAE6OF02JXU4E.31.14.B03.1.454.CMB.1.raw
  modified_base (259)..(259): a, c, t, g, unknown or other
  misc_feature (259)..(259): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatcgtggggagcgtggtccggcctgggggtcctgagactctcctgtgcatgtctgcgtctgaattcatcctcaggcactagtggcagtcgctacgtgggtcccgcagggcccccaggccaaaggggctggagtgggtgctatttanacatttgattggaagaattaaaaatttcgacagactcgtggaacgggccattcacctatctccaaggacgacccgttaccaaccatacgctagtaactctaccaaatacgaactagtggtacgactaggtacgaagacaacggactaaacgtttattaacgtggtacacggtaaagtagtttacggttacggtacgtagcgtaacttgaaacgttggtggtaagtagggttcgacgttacgaaccgtaccggtggggaccaagggaacctacgtagggtacctaccgttcgtaccttacgacgttccctaccgtaacccgaaggggtcccctaaggttccgggtaccccgtttcccccgtaggtaccccggtacccccgttaacccgtcccggtaaacggcccggtacccttaacccggg

SEQ ID NO: 43507 - DNA, 565 bp, Homo sapiens
  misc_feature: GYAE6OF02IPKWN.31.14.B03.1.454.CMB.1.raw
  modified_base (254)..(254): a, c, t, g, unknown or other
  misc_feature (254)..(254): n is a, c, g, or t
  modified_base (464)..(464): a, c, t, g, unknown or other
  misc_feature (464)..(464): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaatttgatggagataaaaaattttacgcagactccgtgaagggccgattcaccatctccagagacccttccaaccataccgctgtatctaccaaatgaacatggtgacagttagaagacaacggcaaacttattattgtgacgaaagtattcggttggttcgagcatcaatgtggatagggtgctcgacaccgtggggccagggaacncgtggtcaccgtctcctcacgccctccaccgtaacgggccctaagtcccggttccttcccccgtgggcccacccttccctacccaacggtcgacctacccg

SEQ ID NO: 43508 - DNA, 747 bp, Homo sapiens
  misc_feature: GYAE6OF02JZXAQ.31.14.B03.1.454.CMB.1.raw
  modified_base (263)..(263): a, c, t, g, unknown or other
  misc_feature (263)..(263): n is a, c, g, or t
tcagcagtagacgtcacgaccggtgctcgatttagtgtgagtagtttgggtcgtgagctgggtttccgttcgttgtctctttaagtaggtgtccagtgtcaggtgcacctggtggaatcgtggggaggcgtggtccggccgtgggggtcccgtgagactctcctgtgccatgtctgcgtctgaattcatcctcaggcactatggcatgcacgtgggtccgccaggcccccaggcaagggtactgggagtgggtggcagtttanacaatttgatggagaattaaaaattttacgacagactccgtgaagggccattcaccatctccagacgacccctccaaccatacgctgtatcctacaaaactgaacatggtgactagttgaaagacgacgactaaacttattattgtacgacgtaaaagtacgttttcgttagggtttacgaaggtacctaacttacgtaaacgtttagggtacgggttaaagttacggggggtttacgggccgttaccgggtaaaccacccgggtttacgggggggacccgaaacgggggaaaccctaaccggttacgggttacccgtaacccgggttcccttacccccgttacgaaccggttaccccctaccccggaaacccgtacccgggggacccccttaaccgggttcccgggttacccccgtttcccccccgtagggcccccgtaacccctccccgttaaccgaacggtacccgcccgttaacccccgg

SEQ ID NO: 43509 - DNA, 561 bp, Homo sapiens
  misc_feature: GYAE6OF02H6FWG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtgcatttatacaatttgatggagaataaaaattttacgcagactccgtgaagggccgattcaccatctccagacgaccccttccaaccatacgctgtatctaccaaatgaacatggtagactagttgaagacacggcaacttattatttgtagacgtaaagtatttcgttggttcgagcatcaatgtaggatagggtgctcgacaccgtggggaccagggacacgtggtcaccgtctcctcagccctaccaccgaacgggcccagtccggtcccttcccccgtggccctacccctcctacccgaagccgcctacccg

SEQ ID NO: 43510 - DNA, 741 bp, Homo sapiens
  misc_feature: GYAE6OF02J0MPM.31.14.B03.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtctgagctgggttttccttcgttgctctttaagtaggtgtccagtgtcaggtgcacctggtggaatctggggaggcgtggtccggccgtgggggtccctgagactctcctgtgccatgtctgcgtctgaattcatcctcaggcactatggcatgcactgggtcccnccaggcccctaggctaagggactgggagtgggtgcaatttanacaatttgatggagaattaaaaactttacgcagactccgtagaagggccattcaccatctaccagacgtaccccttcaaaccgntaccggctgtactcctaccaaaatcgaacctaagtgggtanaacctaggttagaaagaccgacggtactaaacttttattaacttggtacgaccgtaaaaagtcgtttttacggtttcgggttacgaacggtctaacgttacaaaggttggtgggttaaagttacggggggtggtcccttacggaacctaacccggttgggggggacccctaaagggggaaccttacggttcggggtacccctaacccggtttcctaccctacgtaaccggtccccttacccaaccgggaaaccggggtccccctaacgtttcccggggtttccccctttccccccgtgggtacccccctaacccccttcccggttaacccgaaaacggtccggtacccccttacccgg

SEQ ID NO: 43511 - DNA, 586 bp, Homo sapiens
  misc_feature: GYAE6OF02F5QP8.31.14.B03.1.454.CMB.1.raw
  modified_base (408)..(408): a, c, t, g, unknown or other
  misc_feature (408)..(408): n is a, c, g, or t
  modified_base (471)..(471): a, c, t, g, unknown or other
  misc_feature (471)..(471): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaaggggactgggagtgggtggcatttatacaatttgatggagaataaaaattttacgcagactccgtgaagggccgattcaccatctccagacgaccccttaccaaccatacgctgtactcctaccaaatgaacatggtgacagttgaagacacgctaacttattattgtgacgaaagtntttcgttggttcgagcatcaatgtaggagtagggtcgctcgacaccgtggggaccagggaacncgtggtcaccgtcctcctcacgccctaccaccgaacgggcccctagttcccggttccctttccccccgnggtcccctaccccgttccccgtaccgaacggtccgaccctacccgg

SEQ ID NO: 43512 - DNA, 561 bp, Homo sapiens
  misc_feature: GYAE6OF02HMW4Q.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagaccccttccaaccatacgctgtatctccaaatgaacatggtgacagttgaagacaacggcaaacttattattgtgacgaaagatttcgttggttcgagctatcaatgtggataggggtgctgacaccgtggggccagggacacgtggtcaccgtctcctcgagccctaccaccgaacgggccccagttccggtcccttcccccgtgggcccaccctccctacccaaacggtcgccctacccgg

SEQ ID NO: 43513 - DNA, 549 bp, Homo sapiens
  misc_feature: GYAE6OF02F9AN0.31.14.B03.1.454.CMB.1.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttagggcgtggagcgtgggtttcctcgttgactcttttaagaggtgtccagtgtcaggtgcacctggtcggaactcctggggagcgtggtcccggcctgggggtccctgaggactctcctgtgccatgtctgcgtctagaattcatcctcaggcactatggcatgcacgtgggtccnccaggccccaggcaaagggctggagtggtacgntatttanactaatttgatgagataaaaatttacgnagactccgtagaaggccgattcaccgatctccagcgacccttcaaccagtacnctgtancttaccaaatgaacngttgngacagttgaagacagacaacttatatgtagacgaagtattcgttaggttcgagcatcaatgtgactaggttcggcttacgacacgtgggccaggacagtgtcacgtcactcganccctnaccacgggccagtcggtaccttcccgtaggccctcctccgttacacggtacncctacccgg

SEQ ID NO: 43514 - DNA, 601 bp, Homo sapiens
  misc_feature: GYAE6OF02GXCYP.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagaataaaaaattttacgacagactccgtgaagggcgattcaccatctccagagacccttccaaccatacgctgtatctaccaaatnaacatggtgactagttagaagacacggcaacttattattagtgacgaaagtatttcgttggttacgagtcatcaatgtggtagtagggtgctacgacaccgtggggccgaagggaacctacgtggtacctaccgttcctcctcacgccctcccgaaccgaacgggtccccaacggttcccggttaccctttcccccccgtggaccccctacccccgttccctaccccgaacggtaccgcctaaccccgg

SEQ ID NO: 43515 - DNA, 544 bp, Homo sapiens
  misc_feature: GYAE6OF02HQDDZ.31.14.B03.1.454.CMB.1.raw
  modified_base (214)..(214): a, c, t, g, unknown or other
  misc_feature (214)..(214): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagtattcgttggttcgagcatcaatgtaggatagggtgctcgacaccgtggggccagggaacacgtggtcaccgtctcctcacgcctccaccaacgggcccagtccggtccttcccccgnggtccaccctcctacccaagacgctacccg

SEQ ID NO: 43516 - DNA, 557 bp, Homo sapiens
  misc_feature: GYAE6OF02JI98J.31.14.B03.1.454.CMB.1.raw
  modified_base (371)..(371): a, c, t, g, unknown or other
  misc_feature (371)..(371): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaattttgatggagataaaaaattttacgacagactccgtgaaggccgattcaccatctccagacgacccttaccaaccatacgctgtatctaccaaatgaacatgtgacagttanaagacacgcaacttatattgagagaaagtattcgttgtcgagcatcaatgagatagggtgctagacacggtgggccaagggaacacgtggtacctacgtctcctcagccctccgaccgaacgggtcccatccggtcccttccccgtggaccctacccctccgtacccaacggtaccgcctacccgg

SEQ ID NO: 43517 - DNA, 695 bp, Homo sapiens
  misc_feature: GYAE6OF02IG3VX.31.14.B03.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggcgttggagctgggttttcctcgttgctcttttaagaggtgtccagtgtccaggtgcacctggtgaatctggggagcgtggtccgctggggtccctgagactctcctgtgccatgtctgcgtctgaatttcatcctnaggtctactagtggcatgccactgggtccgccaggccccaggcaagggactgggaggtgggtaggctatttagtacaatttgatggaagtataaaaagttttacgcagactcgtgaaggcctaagttcaccgacttccttaccacggacgtacccttaccgaaacctactacgctagtactctaccaaatgaactagtggtagtacgtagttacgaacgacgaacgtactaaactttaattaacgttgtagtacgtaaagtagtttacggtttacggtttacgagtacttaattacctaagttagttaggtagttagggttgtacgtacgaccgtaccggtacggggtacccgtaagggtaaccgacgttacggtaccgtaaccgttccgtacctccgaaccgtacccgtaccgaacccgaacgggtaccctaaccgtcccggttaccctttcccccgttacggtcccctaccccgttcccttacccgtaacgtccctactaaccccgg

SEQ ID NO: 43518 - DNA, 564 bp, Homo sapiens
  misc_feature: GYAE6OF02G28BO.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccagggcaaggggactgggagtgggtgcatttanacaatttgatggagataaaaaattttacgcagactccgtgaaggccgattcaccatctccagagaccttccaaccatacgctgtatctacaaatgaacactggtgacagttagaagacacggcaaacttattattgtgacgaaagtattcgttaggttcgagcatcaaatgtaggagtagggtgctcgacaccgtgggaccgagggaacacgtggtccacgtcctcctcgacgtcctaccaccgaacgggcccaacgtccggtccttaccccgtgcctaccccgtcctaccgaacgacgcctacccgg

SEQ ID NO: 43519 - DNA, 549 bp, Homo sapiens
  misc_feature: GYAE6OF02JN06U.31.14.B03.1.454.CMB.1.raw
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagaataaaaattttacgacagactccgtagaaggccgattcaccatctccagacgacccttaccaaccactacgctgtactctaccaaatagaactatggtagactagttagaagacaacggactaacttattaattgtagacgtaaagtatttcgtttaggttcgagcaatctaatgtaggagtagggtgactcgacacgtgggcaggacacgtgcacgtctcncanccncacacggcctatccggtcctcccgtgcccacctccctacgacgcgacctccg

SEQ ID NO: 43520 - DNA, 548 bp, Homo sapiens
  misc_feature: GYAE6OF02HWRLE.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccagggcaagggactggagtgggtgcatttatacaatttgatggagataaaaattttacgcagactccgtgaagggccgattcaccatctccagagacccttccaaccatacgctgtatctaccaaatgaacatggtgacagttgaagacacggcaactttattattgtagcgaaagatttcgttggttcgagcatcaatgtggatagggtgctcgacacgtgggccaggacacgtggtcaccgtctcctcacgcctccaccgaacgggcccagtccggtccttcccccgtggtacccacccgtccctaccgaacgacgcctaacccg

SEQ ID NO: 43521 - DNA, 559 bp, Homo sapiens
  misc_feature: GYAE6OF02HQW3M.31.14.B03.1.454.CMB.1.raw
  modified_base (253)..(253): a, c, t, g, unknown or other
  misc_feature (253)..(253): n is a, c, g, or t
  modified_base (400)..(400): a, c, t, g, unknown or other
  misc_feature (400)..(400): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtgcatttanacaatttgatggaagataaaaattttacgcagactccgtgaagggccattcaccatctccagagacccttccaaccatacgctgtatctaccaaatgaacatggtgacagttgaagacacggacaacttattattgtgacgaaagtntttcgttggttcgagcatcaatgtggatagggtgctcgacaccgtggggccagggaacacgtggtccaccgtctcctcacgccctccaccgaacgggcccaacgttccggtcctttcccccgnggccctacccctccctacccaacgtcgcctacccgg

SEQ ID NO: 43522 - DNA, 565 bp, Homo sapiens
  misc_feature: GYAE6OF02IUTFU.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagataaaaaattttacgcagactccgtgaagggccgattcaccatctccagacgacccttccaaccatacgctgtatctaccaaatgaacatggtgactagttagaagacacggacaactttattattgtgacgaaagtatttcgttggttcgagcatcaatgtggtatagggtgctcgacaccgtgggccagggacacgtggtcaccgtctcctcgacgccctaccgaccgaacgggccctacgtccggtccctttcccccgtggcccacccgttccctaccaacgacgcctacccgg

SEQ ID NO: 43523 - DNA, 655 bp, Homo sapiens
  misc_feature: GYAE6OF02I94B6.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacatttgatggagataaaaattttacgcagactccgtgaagggccattcaccatctccagacgacccttccaaccatacgctgtactcccaaatgaacatggtgacagttgaagacacggcaacttattattgtagacgaaagtatttcgttagggttcgagctatctaaagttcggtagggtaagttaggggtcggtaccgttcggaacccgacccggttcgggggacccgaagggggaaccctacgttacggggttccctaacccggttccttcccgttaccaaccgtcccctacccgaacccgacggggtacccccgaagttcccgggttccctttccccccgtcggacccttacccccgttccctacccgaaggaccgtacccgtacccgttccgggg

SEQ ID NO: 43524 - DNA, 578 bp, Homo sapiens
  misc_feature: GYAE6OF02IW33A.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttanacaatttgatggagataaaaattttacgcagactcgtgaaggccgattcaccatctccagacgacccttaccaaccatacgctagtatctaccaaatgaacatggtagacagttagaacgacgacgactaacttattatttgtagacgaaagtattacgttggttacgagctatactaaatgtaggtagtagggtggctacgacaccgtggggaccaagggaactacgtaggtccaccgttctcctcacgccctacccaccgaacgggccctacgtccggtccttccccgtcgcccacccctccgtacccaagaccgacctacccg

SEQ ID NO: 43525 - DNA, 551 bp, Homo sapiens
  misc_feature: GYAE6OF02GLWST.31.14.B03.1.454.CMB.1.raw
  modified_base (397)..(397): a, c, t, g, unknown or other
  misc_feature (397)..(397): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagntttcgttggttcgagcatcaatgtggatagggtggctcgacaccgtggggccagggaacactggtcaccgtctcctcacgcctcaccgaacgggcccatccggtcctttaccccccgtggacccacccctcctacccgaacgacgcctaccccg

SEQ ID NO: 43526 - DNA, 550 bp, Homo sapiens
  misc_feature: GYAE6OF02GHZUZ.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagacgacccttccaaccatacgctgtatctccaaatgaacatggtgacagttgaagacacggctaacttattattgtagacgaaaagtatttcgttggttcgagcatcaatgtggatagggtgctcgacaccgtggggccagggaaccacgtggtccaccgtctcctcacgccctcaccaacgggcccatccggtccttccccgtggcccaccctccctaccgaacgcgctacccg

SEQ ID NO: 43527 - DNA, 542 bp, Homo sapiens
  misc_feature: GYAE6OF02HCO3O.31.14.B03.1.454.CMB.1.raw
  modified_base (420)..(420): a, c, t, g, unknown or other
  misc_feature (420)..(420): n is a, c, g, or t
  modified_base (456)..(456): a, c, t, g, unknown or other
  misc_feature (456)..(456): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagaccccttccaaccatacgctgtatctccaaatgaacatggtgacagttgaagacacggcaacttattattgtgcgaaagattcgttggttcgagcatcaatgnggatagggtgctcgacaccgtggggaccagggaacncgtgggtcaccgtctcctcacgcctccaccgagggccccagtccggtccttcccccgtggcccaccctcctaccaacgcgcacccg

SEQ ID NO: 43528 - DNA, 546 bp, Homo sapiens
  misc_feature: GYAE6OF02GZ4RK.31.14.B03.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggacaacttattattgtagcgaaagattcgttggttcgagcatcaatgtggatagggtgctcgacaccgtggggccagggaacncgtggtcaccgtctcctcacgcctccaccacgggccccagtccggtccttcccccgtggcccaccctccctaccaacgacgcctacccg

SEQ ID NO: 43529 - DNA, 544 bp, Homo sapiens
  misc_feature: GYAE6OF02HC2LC.31.14.B03.1.454.CMB.1.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagagacccttcaaccatacgctgtatctccaaatgaacatggtnacagttgaagacacggcaacttattattgtgacgaaagtattcgttggttcgagcatcaatgtggatagggtgctcgacaccgtgggccagggacacgtggtcaccgtctcctcacgcctccaccgacgggcccatccggtccttcccccgtggcccaccccttcctaccaacgacgcctaacccgg

SEQ ID NO: 43530 - DNA, 580 bp, Homo sapiens
  misc_feature: GYAE6OF02I1RL4.31.14.B03.1.454.CMB.1.raw
  modified_base (401)..(401): a, c, t, g, unknown or other
  misc_feature (401)..(401): n is a, c, g, or t
  modified_base (495)..(495): a, c, t, g, unknown or other
  misc_feature (495)..(495): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaatttgatggagaataaaaattttacgcagactccgtgaagggccgattcaccatctccagacgacccttaccaaccatacgctgtatctaccaaatcgaaacagtggtgactagttagaagacacggactaacttattattgngacgaaagtattcggttggttacgagcatcaagtggtggaagtagggtgctcgacacggtgggaccagggacacgtggtcaccgttctcccgtnacgtcctacccgacgaccgggccctagtcccggtccttcccccgtcggccctacccttccctacccgaagccgtaccctacccgg

SEQ ID NO: 43531 - DNA, 556 bp, Homo sapiens
  misc_feature: GYAE6OF02F6GG8.31.14.B03.1.454.CMB.1.raw
  modified_base (549)..(549): a, c, t, g, unknown or other
  misc_feature (549)..(549): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaattttacgcagactccgtgaagggccgattcaccatctccagagacccttccaacccatacgctgtatctccaaatgaacatggtagacagttgaagacacggacaacttattattgtgacgaaagatttcgttggttcgagcatcaatgtggagtagggtggctacgacaccgtggggccagggaaccagtggtccaccgtctcctcacgccctccaccgaacgggcccagttccggtccttcccccgtggccctaccctccctaccaacgacnctacccg

SEQ ID NO: 43532 - DNA, 549 bp, Homo sapiens
  misc_feature: GYAE6OF02IUOE8.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggcccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgacgaaagtattcgttggttcgagcatcaaatgtggatagggtgctcgacaccgtgggccagggacacgtggtcaccgtctccctcagccctccgaccaacgggcccaatccgggtccttcccccgtggcccacccgtccctacccaagtaccgctacccg

SEQ ID NO: 43533 - DNA, 542 bp, Homo sapiens
  misc_feature: GYAE6OF02HOK8T.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaatttacgcagactccgtgaaggccgattcaccatctccagagacccttccaaccatacgctgtatctccaaatgaacatggtgactagttagaaagacacggacaaacttattattgtgacgaaagtattcgttggttcgagcatcaatgtaggatagggtgctcgacaccgtgggccagggacacgtggtcaccgtctctcacgcctccaccgaacgggcccagtccggtccttccccgnggccaccctcctaccaagacncctaccg

SEQ ID NO: 43534 - DNA, 545 bp, Homo sapiens
  misc_feature: GYAE6OF02HB9FV.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattatttgtgcgaaagattcgttggttcgagcatcaatgtggatagggtgctcgacacctggggccagggaacactggtcaccgttctcctcagccctccacccaacgggcccattccggtccttccccccgtggcccacccgtccctcccaagacgcctacccg

SEQ ID NO: 43535 - DNA, 546 bp, Homo sapiens
  misc_feature: GYAE6OF02H2SKW.31.14.B03.1.454.CMB.1.raw
  modified_base (254)..(254): a, c, t, g, unknown or other
  misc_feature (254)..(254): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaattttgatggagataaaaaattttcgcagactccgtgaagggccgattcaccatctccagagacccttccaaccatacgctgtatctccaaatgaacatgtgacagttagaagacacggcaacttattattgtgcgaaagattcgttggtcgagcatcaatgtgatagggngcccgancctgggcagggaacacgtggtcaccgtntcctnacgcctccaccaacgggcccagttccggtccttccccctggccctacccgccctacccaagtacgcccaccgttccgg

SEQ ID NO: 43536 - DNA, 628 bp, Homo sapiens
  misc_feature: GYAE6OF02G8NW7.31.14.B03.1.454.CMB.1.raw
  modified_base (364)..(364): a, c, t, g, unknown or other
  misc_feature (364)..(364): n is a, c, g, or t
tcagcagtagacgtcacgaccggtgctcgatttagtgtgagtagtttggtttagggggagctaacgaaccaacggcacggcaggggcagccaagatggtgttgccagacccaggtcttcgagtttcctctgttgcttcttggatcgtctggtgccttacggggacatcgtcgatcgagccagtttcccagacctcccgtggctgtgtctcgtgggcgagagggccaccgagtccaacgtgcaagtccagcccagagttgttttattcggcccccacgtaataacaacttaccttagcgttggtaccagtcagaaagtggacacgcctaccgtaactcgtgatttacgtgggcttcgacccgggntacgtcccggggttaccaaccgtattcagtttggcaggcgggtctgggaccgtatttcgactctcaccatccgagcgacgcctgccgaggctaggaacgtacgtggtacggacgtaggtttactacgtcgtcacgactaactattacgtacttcgtttcgtcctacgtttcggacggtagggaccgagggtggagtacgtacgaaacggtacgttggtacggtccgtggtaccgaccgtacttccgtcggttacgttcgtaccg

SEQ ID NO: 43537 - DNA, 600 bp, Homo sapiens
  misc_feature: GYAE6OF02GDCD6.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (398)..(398): a, c, t, g, unknown or other
  misc_feature (398)..(398): n is a, c, g, or t
tcagcagtagacgtcacgaccggtgctcgatttagtgtgagtagtttgggctgagcgtggtttcgtcgttaggctctttaagaggtgtccagtgtcaggtgcacctggtggaatctggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaattttcgcagactccgtgaagggccattcaccatctccagacgacccttcaaccatacgctgtatctccaatgaacntggtnactagttgaagactacggactaacttattattgtagcgaaaagtnttccggttaggttcgagtcatcaagtgtgggaataggggtgctcgacaccgtggggacctagggacacgtggtccaccgtctccgttcgcgccctcccgtaacgaacggggtccccaagttcccgggtacccctttccccccggtgggaccccctacccccgttacccgttacccgaacgggtacgtaccccgtaaccccgg

SEQ ID NO: 43538 - DNA, 731 bp, Homo sapiens
  misc_feature: GYAE6OF02H860P.31.14.B03.1.454.CMB.1.raw
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
tcagcagtagacgtcacgaccggtgctcgatttagtgtgagtagttgggcgtgagctgggtttcctcgttgctctttaagaggtgtccagtgtcaggtgcacctggtggaatcgtgggggaggcgtggtccggccgtgggggtccctgagactctcctgtgccatgtctgcgtctagattcatcctcaggcactagtggcatgacgacgtgggtccgccaaggccccagggcaagggtctgggagtgggtgacattttagactaatttgatggagtaataaaaatttacgcagactccgtggaaggcgattcaccatctccagagacctcaacatacgctgtancaccaaatgacatgtnacgagttgaagcaacggactaaccttattaatggtanaccggtaaagtaagtttccgggttagttaaccggaggtaacgtaactttaccaaacttgggttagggtaaacgttaacgggggttggacccgttacggttaccgaacccgggttaggggggtaccccggtaaggggtaaaccgaccggtttaacgggccgtaaacccggttacccgttcccggttaaccaaccggggttcccaccccgttaacccggaaaccgggcccccgtaaaccggttccgggttacccccggtttccccccgttaggggacccctaacccccgggttcccctaaacccggtaaccgttaaccggccttaaccccccgggg

SEQ ID NO: 43539 - DNA, 574 bp, Homo sapiens
  misc_feature: GYAE6OF02FFF99.31.14.B03.1.454.CMB.1.raw
  modified_base (413)..(413): a, c, t, g, unknown or other
  misc_feature (413)..(413): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactggggtcccgccaggccccaggcaaggggactgggagtgggtggcatttatacaattttgatggagaattaaaaaattttcgacagactccgtgagggccattcaccatctccagacgacccttccaaccatacgctgtatctaccaaatgaacatggtagacagttagaagacacggactaaacttatttatgtacgacgtaaagntttcggttggtttcgagcaattcaagtggtaggagtaggggttgcctcgacaccgtggggcccagggaacacgtggtcctaccgtcctcctcacgccctccaccgacgggcccagtccggtccttcccccgtgcccaccctcctaccaacgacgcctaccg

SEQ ID NO: 43540 - DNA, 555 bp, Homo sapiens
  misc_feature: GYAE6OF02JEDYB.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (525)..(525): a, c, t, g, unknown or other
  misc_feature (525)..(525): n is a, c, g, or t
  modified_base (547)..(547): a, c, t, g, unknown or other
  misc_feature (547)..(547): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagaataaaaattttacgcagactccgtgaagggccgattcaccatctccagacgacccttccaaccatacgctgtactctaccaaatgaacatggtgacagttagaagacgacgactaacttattattgtagacgaaagtatttcgttaggttcgagctatcaatgtggagtagggtgctcgacaccgtgggccagggacacgtggtcaccgtctcctcgacgccctaccgaccgacggcccagtccggtccttccccgnggcccaccctcctccaacgacncctacccg

SEQ ID NO: 43541 - DNA, 579 bp, Homo sapiens
  misc_feature: GYAE6OF02IJKTX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagataaaaaattttacgcagactcgtgaaggcgatcaccatctcagagacccttccaaccatacgctgtactctaccaaatgaacatggtgactagttagaagacacggactaacttattatttgtagacgaaagtatttcggttggttcgagtcatacaatgtaggagtagggtggtctcgacaccgtggggaccagggaacacgtcggtaccaccgtctcctccgacgcctaccaccgaccgggccctacgtccggttccttcccccgtggcccctacccgtacccttacccgaacgtccgacctacccgg

SEQ ID NO: 43542 - DNA, 628 bp, Homo sapiens
  misc_feature: GYAE6OF02INLE7.31.14.B03.1.454.CMB.1.raw
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccacggcccccaggccaaggggactgggagtggggtggcatttanactaatttgatggagaataaaaaattttacgcagactccgtggaagggccgattcaccatcctcagacgaccccttccaaaccactacgctgtatctacctaaatgaacagtggtagactagttagaacgacgacggactaacttattattgtagacgaaagtagtttcgttggttacgagctatactaaagtgtaggaagttaggggtcggtactcggaacaccggtggggccgaagggaaccacgttcggtaccgaccgtcctctccgaacgtcccgtacccaaccggaccgggcccctagtcccgggttcccttccccgtccggtcccaccccgttccgacccgaacgtaccgcctaacccgg

SEQ ID NO: 43543 - DNA, 626 bp, Homo sapiens
  misc_feature: GYAE6OF02G2JD8.31.14.B03.1.454.CMB.1.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggctgagcgtggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccagggcaagggactgggagtgggtggcatttatacaatttgatgganaataaaaattttcgcagactccgtgaaggccgattcacatctaccagacgacccttcaaccatacgctgtatcctacaaatgaacntggtgactagttgaagacgacgactaacttattatgtgacgaaagtnttcggttgtcgagctatcaattggaggtagttaggggngtctacggacctaccggttgggggaccctaaggggactaccgtgggttacccaccgttcctccctaccgacgtccccttacccgaacccggtaacggggtccccctaagttcccggttcccgtttacccccccgggtacccctaccccttccctacccggaaacggtaccgcccttaaccccggg

SEQ ID NO: 43544 - DNA, 807 bp, Homo sapiens
  misc_feature: GYAE6OF02JKKQ4.31.14.B03.1.454.CMB.1.raw
tcagcagtagacgtcacgaccggtgctcgatttagtgtgagtagtttgggctgagctgggttttcctcgttgctcttttaagtaggtgtccagtgtcaggtgcacctggtggaatctggggaggcgtggtccggccgtgggggtcccgtgagactctcctgtgccatgtctgcgtctgaattcatcctcaggcactatggcatgcacgtgggtcccgccaggcccccaggccaagggactgggagtggggtggcatttataacaatttgatggagtaattaaaaaagttttaccgctaagaccttccggtaggaaacggggccgtaatttccaaccattcctccagacgtaccccttccaaccatacgctgtatcctaccaaatcgaacattggtagaacctagttacgaaagaccaaccgggactaaactttactttaagtttggtacgaacgtaaaagtagttttccggtttagggttacgaggtctaagttacctaaagttggttagggaagtttagggggttacggcccgttaccggaacctacccgggttagggggaccccgtaagggggtaaaacccaccggtttaccggggtaccctaaccccggtttccgtaccccgtttaccggaaccgtcccccgttaccccggaaaccccgggtaaacccgggggtcccccctaacggtttaccccggggtttccccccttttaccccccccccgggtaggtacccccccgttaacccccccttacccccgttaacccccggaaaacgggtacccggtacccccgtaacccccggg

SEQ ID NO: 43545 - DNA, 554 bp, Homo sapiens
  misc_feature: GYAE6OF02JTTLU.31.14.B03.1.454.CMB.1.raw
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
tcagcagtagacgtcacgaccggtgctcgatttagtgtgagtagtttgggctgagcgtggtttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccaccaggccccaggcaagggactgggagtgggtggcatttatacaatttgatggagataaaaatttcgcagactcgtgaagggccgattcaccatctccaggacacccttcaaccatacgctgtatctccaaatgaacatggtgacagttgaanacacggcaactttatatttgtagacgtaaagtntttcggttggttacgaggtcatacaatggtggtataggggtgctcgacaccgttggggccagggacacgtcgggtcaccgtctccgtcacgccctcaccgacggcccagttccggtccttccccagggccacccgtccctaccgacgtcgcctaccg

SEQ ID NO: 43546 - DNA, 545 bp, Homo sapiens
  misc_feature: GYAE6OF02HSEK2.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttatacaatttgatggagataaaaaattttacgcagactccgtgaagggccgattcaccatctccagagacccttccaaccatacgctgtatctccaaatgaacatggtgacagttgaagacacggcaacttattattgtgacgaaagtatttcgttggttcgagcatcaatgtggatagggtggctcgacaccgtggggccaggggacacgtggtcaccgtctcctcacgcctccaccgaacgggcccaagtccggtccttcccccgtggccaccctcctcccaagcgcctacccg

SEQ ID NO: 43547 - DNA, 567 bp, Homo sapiens
  misc_feature: GYAE6OF02F5WDG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaatttacgacagactccgtgaagggccgattcaccatctccagagacccttccaaccatacgctgtatctccaaatgaacatggtgacagttgaagacacggacaacttattattgtgacgaaagtatttcgttggtttcgagcatcaatgtggatagggtgctcgacaccgtgggccagggacacgtggtaccaccgtctcctcacgccctaccgacccgaacgggccccaacgttccgggttcccttcccccgtcggccctaccccctccctaccgaacgacgccctacccg

SEQ ID NO: 43548 - DNA, 1074 bp, Homo sapiens
  misc_feature: GYAE6OF02GH2BY.31.14.B03.1.454.CMB.1.raw
  modified_base (899)..(899): a, c, t, g, unknown or other
  misc_feature (899)..(899): n is a, c, g, or t
tcagcagtagacgtcacgaccggtgctcgatttagtgtgagtagtttgggctgagcgtggtttccgcgtaggctctttaagaggtgtccagtgtcgaggtgcaccgtggtaggaatcggtgggggagcgtggcccggcggtcgggggtccctggagactcctcctgtcgaccatgtctggcgtctagtaacttcattccctgaggcctaacttagtggccagtgacctacggttcgggggtcccgacccgaccgggcccccagggaccgaaaagggggtaccgtaggggagggttgggggggtccgaccttaaatttttaataaaccttaaagttttggaagttaggggaaagtaaaaacttttaaaaaaaatttttccggacaacggtaacccttacccggtaaggggaaacgggggcccgtaaacgtttccaaccctaacttcctaccgaacgaaccggtaacccccctttaccccaaaacccgtaagttaacgtccttaggttaaccttacctaaccctaaaaagttccggaaaaaccttaagtttagggggtcgaaaccgttagggttttaaaccgggaaaagtaacccggaaccggggtaacccttaaaaacctttttaacttttaaaggtttttacggtagggaaaaccccggtaaaaaaggttaccttttttaccggggttttaggggtttaacccgggaaggtacccgttaaagtaacccttaaaaggttccggggttaagggtaaacggtttaaggggggggttcggtaacccgtttacccgggaaacccgttaccccgggggttagggggggaaccccggaaaggggggtaaacccttaacccggggtttggggttaacccctaaccccggttaccttcccccggttanaacccggtccccccttaccccgaaacccggtaaaccgggggttccccccaacgggttttcccccgggtttaacccccccttttcccccccgggtccgggtaaccccccgttaccccccccttacccccggtttaacccccgaaaacgggtacccggccccctttaacccccgggg

SEQ ID NO: 43549 - DNA, 614 bp, Homo sapiens
  misc_feature: GYAE6OF02HUMX2.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggctatttatactaatttgatggaagaattaaaaaattttacgacagactccgtgaagggccgattcaccatctcagacgacccttccaaccatacgctgtactctaccaaatacgaacatggtagactagttagaaagacaacggtacaaactttattattgtagacgaaagtatttacggtttggtcgagctatactaagtgtggaagttaggggtgcgtacgaccgtaccgtggggaccaaggggaacctcgtacggtccaccgttcctccacctacgccctaccaacccgaacgggcccctacgttccggtcccttcccccgtcggccctaccccgtcccgtaccgaacggccgtccctaacccgg

SEQ ID NO: 43550 - DNA, 557 bp, Homo sapiens
  misc_feature: GYAE6OF02G9F34.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaattttacgcagactccgtgaagggccgattcaccatctccagacgacccttccaaccatacgctgtatctaccaaatgaacatggtgacagttgaagacacggcaacttattattgtgacgaaagtatttcgttggttcgagcatcaatgtaggagtagggtgctcgacaccgtggggccgagggacacgtgggtcaccgtctcctcacgcctcccaccgaacgggccccagtccggtccttcccccgtggccctaccccgtcctccaacgtacgcctacccg

SEQ ID NO: 43551 - DNA, 605 bp, Homo sapiens
  misc_feature: GYAE6OF02GJT0A.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccaggccccaggccaagggactggagtgggtggcatttanacatttgatggagaattaaaaatttacgcagactccgtagaagggccgattcaccatctccagacgacccttaccaaccatacgctgtatctaccaaatgaacatggtagacagttagaagacacggactaacttattattgtagacgtaaagtatttcgttggtcgagactagtacaagtgtaggagtagggtgcgtcgacaccggtggggaccgaagggacctacgtcggtaccaccgttcctcctcgaccgccccttacccgaccgaaccgggcccctacgttcccgggtcccttcccccgtccggaccctacccctaccctacccgaacgtaccgccctacccgg

SEQ ID NO: 43552 - DNA, 642 bp, Homo sapiens
  misc_feature: GYAE6OF02F6KUE.31.14.B03.1.454.CMB.1.raw
  modified_base (253)..(253): a, c, t, g, unknown or other
  misc_feature (253)..(253): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaatttacgcagactcgtgaaggccgattcaccatctccagacgacccttccaaccatacgctgtatctccaaatgaacatggtgacagttgaagacacggactaacttattattgtgacgtaaaagntttcggttggttcgagtctaatacaagttggtaggtaagtagggtggtcctacgaaccgtaccgggtggggacccgaaggggtaaccacggttcgggtacccgtacccgttcctacccgtccgacgtccccacccgaaccggacccgggtcccctaacggtttcccgggttccccctttcccccggacggtaccccctacccccgttccccgtaacccgaacggtaccgtacccctacccgg

SEQ ID NO: 43553 - DNA, 594 bp, Homo sapiens
  misc_feature: GYAE6OF02IWXT6.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaatggactggagtgggtggcatttatacaattttgatggagaataaaaaattttacgcagactccgtgaaggccgattcaccatcctccagacgacccttccaaccatacgctgtactctaccaaatagaacagtgtgacagttgaagacacggactaaactttattattgtgacgtaaagtatttcggttggttacgagtacatacaagttgtaggtagtaggggtgcgtcgacgaccgtggggaccagggaaccacgtggtacctaccgtcctcctcacgtccctccgacccgaacgggaccccagttcccggtccctttcccccgtcggccctacccccgttcccacccgtaacgaccgtacccg

SEQ ID NO: 43554 - DNA, 546 bp, Homo sapiens
  misc_feature: GYAE6OF02IHRYL.31.14.B03.1.454.CMB.1.raw
  modified_base (398)..(398): a, c, t, g, unknown or other
  misc_feature (398)..(398): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggctggagtgggtggcatttatacaatttgatggagataaaaaattttacgcagactccgtgaagggccgattcaccatctccagagacccttccaaccatacgctgtactctccaaatgaaacatggtgacagttgaagacacggcaacttattattgtgcgaaagtnttcgttggttcgagcatcaatgtggatagggtgctcgacaccgtgggccagggacacgtggtcacccgtctcctcacgccctaccgaccgaacgggcccagtccggtccttcccccgtggccctaccctcctaccaacgcgctacccg

SEQ ID NO: 43555 - DNA, 661 bp, Homo sapiens
  misc_feature: GYAE6OF02G7TIA.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgcaggccccaggcaagggactggagtgggtgctatttatacaatttgatggagaataaaaatttcgcagactccgtgaaggccgatcacatctaccagacgaccccttccaaccataccgcttgtatcctaccaaatacgaacatggtgactagttagaagacacggactaaattattattgtacgacgtaaagtagtttccggttaggttacgagtacattccaaagttggtaggtaagttaggggttcggactaccggaccaccgggttgggggaccctaaggggaacctaaccgttcgggtacctacccggttcctacccgtacaccggtccccttaccgaacccgaacggggtcccctaacggttcccgggtacccctttccccccggtgggtaccccctaccccgttcccgtaccccgaacggtaccgtaccccgtaacccgg

SEQ ID NO: 43556 - DNA, 578 bp, Homo sapiens
  misc_feature: GYAE6OF02JB3WP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtgcatttatacaatttgatggagaataaaaaattttacgacagactccgtagaagggccgattcaccatctccagagacccttccaaccatacgctgtatctaccaaatgaacatggtgacagttagaagacacggactaacttattattgtgacgaaagtattcgttggttacgagctatcaatgtggatagggtgctcgacaccgtgggccagggaacacgtcggtcaccgtctccctcgacgccctaccgaccgaacgggcccctaacgtcccggttacccttcccccgtggaccctacccctcccgtacccaacggacgaccctacccgg

SEQ ID NO: 43557 - DNA, 547 bp, Homo sapiens
  misc_feature: GYAE6OF02GQMY6.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgacgaaagtattcgttggttcgagcatcaatgtggatagggtgctcgacaccgtgggccagggacacgtggtcaccgtctcctcacgcctccacgaacgggcccaattccggtcctttcccccgtggcccacccctcctacccaacgacgcctacccg

SEQ ID NO: 43558 - DNA, 551 bp, Homo sapiens
  misc_feature: GYAE6OF02IQSA0.31.14.B03.1.454.CMB.1.raw
  modified_base (463)..(463): a, c, t, g, unknown or other
  misc_feature (463)..(463): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggagataaaaaattttacgcagactccgtgaaggccgattcaccatctccagacgacccttccaaccatacgctgtatctaccaaatgaacatggtgacagttgaagacaacggacaacttattattgtgacgaaagtacttcgttggttcgagtcatcaagtgtggagtagggtgctcgacacgtgggccagggacngtgtcaccgtctctcagcctccaccgaacggcccaacgtccggttccttcccccgtcggaccaccctcctcccgaactcgcctacccg

SEQ ID NO: 43559 - DNA, 569 bp, Homo sapiens
  misc_feature: GYAE6OF02IAAMU.31.14.B03.1.454.CMB.1.raw
  modified_base (493)..(493): a, c, t, g, unknown or other
  misc_feature (493)..(493): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtggggtgcatttatacaatttgatggagaataaaaaattttacgacagactccgtgaagggccgattcaccatctccagagaccccttccaaaccataccgctagtatcctaccaaatgaacatggtgacagttgaagacacggacaacttattatttgtgacgaaagtatttcggtttggttcgagctaatcaagtgtggagtagggtggctcgacaccgtggggccaagggacacgtggtcaccgtctccncacgccctaccgaccacgggcccagtccggtcccttccccctggccctaccccgtcctaccaacgaccgctacccg

SEQ ID NO: 43560 - DNA, 597 bp, Homo sapiens
  misc_feature: GYAE6OF02HZ7TR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccagggccccccggcaagggactgggagtggggtggcatttatacaatttgatggagaattaaaaaattttacgcagactccgtagaagggccgattcaccatcctccagacgaccctttccaaccatacgctgtatctaccaaatgaaacatggtagactagttagaagaccacggactaaacttattaattgtagacgaaagtatttcgttgggttcgagctatacaatgtggatagggtgctcgacaccgtggggaccaagggaacacgtgtccaccgttcctccgtcacgtcctaccaccgacgggccctagttcccggtaccttcccccgtggcccctaccccgttcctaccccaaggaccgtaccgacccgtccggg

SEQ ID NO: 43561 - DNA, 565 bp, Homo sapiens
  misc_feature: GYAE6OF02I49B4.31.14.B03.1.454.CMB.1.raw
  modified_base (282)..(282): a, c, t, g, unknown or other
  misc_feature (282)..(282): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacatttgatggagataaaaattttacgnagactccgtgaagggccgattcaccatctccagagacccttccaaccatacgctgtatctaccaaatgaacatggtgacagttagaagacacggactaacttattattgtagacgtaaagtatttacgttggttcgagcgatctaatgtaggagtagggtgctcgacaccgtgggccgagggacacgtggtccaccgtctcctcacgcctccaccgaacggccccagtccggtcccttcccccgtggccctacccgttcccacccaacgaccgacctacccgg

SEQ ID NO: 43562 - DNA, 542 bp, Homo sapiens
  misc_feature: GYAE6OF02F3SOA.31.14.B03.1.454.CMB.1.raw
  modified_base (397)..(397): a, c, t, g, unknown or other
  misc_feature (397)..(397): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagacgacccttccaaccatacgctgtatctccaaatgaacatggtgacagttgaagacacggcaacttatattgtgcgaaagnttcgtggttcgagcatcaatgtggatagggtgctcgacaccgtggggccagggacacgtggtccaccgtctcctcacgccctccaccaacgggcccagtccggtccttcccccgtggcccaccctccctccaacgacgctacccg

SEQ ID NO: 43563 - DNA, 627 bp, Homo sapiens
  misc_feature: GYAE6OF02JR5LI.31.14.B03.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcgaagggactgggagtgggtggctagtttatacaatttgatggagaataaaaatttcgacagactcgtagaaggccgattcacatctccagacgacccttacaaccatacgctgtatctaccaaatcgaaacngttggtacaacgtaggttagaaacgacacggacctaaactttattacttgagacgtaaagtatttcggttaggtacgagctatacaagtgtaggagttagggtgtctacgaccgacgtggggacctagggaacctacgttggaccttaccgtctcctacgacgtccctaccgaccgaacgggtccccgtaagtcccgggttaccccttcccccggtaggtaccccctaccccgtcccttacccgaacggtccgtaccccgtaacccgg

SEQ ID NO: 43564 - DNA, 547 bp, Homo sapiens
  misc_feature: GYAE6OF02GLQB7.31.14.B03.1.454.CMB.1.raw
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagacgacccttccaaccatacgctgtatctccaaatgaacatggtnacagttgaagacacggcaacttattattgtgacgaaagtntttcggttggttcgagcatcaatgtggatagggtgctcgacaccgtgggccagggacacgtggtcaccgtctcctcacgccctccaccacgggcccagtccggtccttcccccgnggcccacccctcctcccgaagacgcctacccg

SEQ ID NO: 43565 - DNA, 552 bp, Homo sapiens
  misc_feature: GYAE6OF02HFV1V.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (362)..(362): a, c, t, g, unknown or other
  misc_feature (362)..(362): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagcagtagacgtcacgaccggtgctcgatttagtgtgagtagtttgggctgagctgggttttcctcgttgctcttttaagaggtgttcagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttanacaatttgatggagaataaaaaattttacgcagactccgtgaagggccgattcaccatctccagagaccccttccaaccatacgctgtatctccaaatgaacatggtnacagttgaagacacggcaacttattattgtgacgaaagtattcgttggttcgagcatcaatgtaggatagggtgctcgacaccgtgggccagggacacgtgtcaccgtctcctnacgccnccaccgacggcccactccggtcccttcccccgtcggacctaccccgtcctacccgaagacgcctacccgg

SEQ ID NO: 43566 - DNA, 671 bp, Homo sapiens
  misc_feature: GYAE6OF02JK7ZE.31.14.B03.1.454.CMB.1.raw
  modified_base (404)..(404): a, c, t, g, unknown or other
  misc_feature (404)..(404): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccagtctgcgtctgaattcatcctcaggcactatggcatgcactgggtccgccaggccccaggcaagggactggagtgggtggcattatacaatttgatggagaataaaaatttacgcagactccgtgaaggccgattcacatctccagacgacccttccaaccatacgctgtatcctaccaaatgaacatggtcgacaggttagaagacacggactaacttattagttgtagacgtaaagtntttcggttggttacgacgtactatacaaagtcgtaggtaagttaggggtcgcgttaccggaacgtaccggtggggtacccgaaaggggtaacctaccgttggggtacctaaccccggttccttaccccgacgtaaccggacccgtaccccgtaacccggaggggtacccccctaagggttcccggtttcccgtttaccccccctagggacccctacccccgtttaccctaccccgaaaggcccggtcccgtaaccccgttccggggg

SEQ ID NO: 43567 - DNA, 546 bp, Homo sapiens
  misc_feature: GYAE6OF02GF1MM.31.14.B03.1.454.CMB.1.raw
  modified_base (397)..(397): a, c, t, g, unknown or other
  misc_feature (397)..(397): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaatttacgcagactccgtgaagggccaattcaccatctccagagacccttccaaccatacgctgtatctccaaatgaacatggtgacagttgaagacacggcaaacttattattgtgacgaaagnttcgttggttcgagcatcaatgtggatagggtgctcgacaccgtggggccagggaacacgtggtacaccgtctcctcacgccctccaccgaacgggcccagtccggtccttcccccgtggcccaccctccctaccaacgacgctacccg

SEQ ID NO: 43568 - DNA, 665 bp, Homo sapiens
  misc_feature: GYAE6OF02JAV17.31.14.B03.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggcgtgagctgggttttcctcgttgctccttttaagacggtggtcctagtgtctaggtgtcacctggtggaatctggggaggcgtggtccggcctgggggtccctgaggacttctcctgtgccgatgtctgcgtctgaattcatcctcaggcactatggcatgcactgggtccgccaggccccaggcaagggactggagtgggtggcatttatacaatttgatggagattaaaaaattttacgcaagtactccgtgaaggccgattcaccatctccagacgaccctccaaccatacgctgtatctacaaatgaacatggtnactagtagaagacacggactaacttattattgtagacgtaaagtattttcgttgggtttcgaagtccgtaataacaagttaggtaggtaagttagggggtagcgttaccgaccgtacccggttgggggacccaaggggaactaccgtagggtacccgtaacccgttcttcccgtacacggtacccctacccgaacccgtaaaccgggcccctaacgttcccgggttccctttcccccgtacggtacccctacccccttccccgtaacccaaacgggttaccgaccctaaccccggg

SEQ ID NO: 43569 - DNA, 578 bp, Homo sapiens
  misc_feature: GYAE6OF02I2N9O.31.14.B03.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (409)..(409): a, c, t, g, unknown or other
  misc_feature (409)..(409): n is a, c, g, or t
  modified_base (539)..(539): a, c, t, g, unknown or other
  misc_feature (539)..(539): n is a, c, g, or t
tcagcagtagacgtcacgaccggtgctcgatttagtgtgagtagtttagggacgtgagcgtggtttcctcgttgtcctcctttaacgaggtgtccagtgtcaggtgcgacctgggtggaagtcgtggggaggcgtggtccggcctgggggtccctgagactctcctgtgccatgtctgcgtctgaattcatcctcaggcactatggcatgcactgggtccgccaggccccaggcaagggctggagtgggtgcatttanacaatttgatgganataaaaatttcgcagactcgtagaaggccgattcaccatctccagacgacccttaccaaccataccgctgtatcctaccaaatgaacatggtagacagttagaagacacggctaaacttattattgtgacgaaagtnttcgttggttcgagcatcaatgtagatagggtgctcgacacgtgggaccagggaacacgtggttccaccgttctccctcgactccgtaccacgaacggggccctaacgtccgggttaccctttcccccgnggtacccctacccgttccctaccgaacgcgacctcccgg

SEQ ID NO: 43570 - DNA, 671 bp, Homo sapiens
  misc_feature: GYAE6OF02IF8KC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaatttgatggagtaataaaaattttacgcagactccgtagaaggccgattcacatctcagacgacccttccaaccatacgcttgtactctaccaaatgaacagtggtagactagttagaagacaacgactaacttattattgtagagtaaagtatttcggttggttacgagactatcaagttggtaggaagttaggggtgtccgtacgacctaccggtggggaccgtaagggaacctacgttcgggtaccctacccgttcctacccgttcgaccgtcccctacccgaacccggtaaccggggaccccctaaccggttcccgggtttaccccctttacccccccggtccgggtacccccttacccccggttaccccttaaccccggtaaccggtaccgaccccgttaaccccggg

SEQ ID NO: 43571 - DNA, 569 bp, Homo sapiens
  misc_feature: GYAE6OF02JFDVJ.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (410)..(410): a, c, t, g, unknown or other
  misc_feature (410)..(410): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtgctatttanacaatttgatggagaattaaaaatttacgcagactccgtgaaggccgattcacatctcagacgacccttccaaccatacgctagtatctaccaaatcgaaacatggtgactagttacgaagacacggactaaacttattattgtagacgaaaagtnttcgttaggttacgagcaatcaatgtaggagtagggtgctcgacnccgtgggcaggacncgtggtcaccgtctcctcgacgccttaccaaccgacgggccctagtccggttaccctccccgtggaccctaccccgtccaccgaacgtcgaccctaccgg

SEQ ID NO: 43572 - DNA, 550 bp, Homo sapiens
  misc_feature: GYAE6OF02IY8HS.31.14.B03.1.454.CMB.1.raw
  modified_base (328)..(328): a, c, t, g, unknown or other
  misc_feature (328)..(328): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggtttagggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccacaataacaactacttagcttggtaccagcagaaagtaggacagcctacctaaactcctgatttactgggcttctacccgggnacgtccggggttcctaacgattcattggcagcgggtctgggaccatttcactctcaccatcagcagcctgcaggctagaaagntggtggntagtttatactgtcagacaactattattactttctttcgtctacgtttcggacgggtaggaacctaagggtgagtataacgaaacggtaactggtaggactcggacacctattacgngttaccttctaaccg

SEQ ID NO: 43573 - DNA, 555 bp, Homo sapiens
  misc_feature: GYAE6OF02JDMYM.31.14.B03.1.454.CMB.1.raw
  modified_base (401)..(401): a, c, t, g, unknown or other
  misc_feature (401)..(401): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagacgacccttccaaccatacgctgtatctaccaaatgaacatggtgacagttgaagacacggcaacttattattgtgcgaaagtnttcgttggttcgagcatcaatgtaggatagggtgctcgacaccgtgggccagggaacacgtcggtcaccgtctccctcacgccctccgaccgaacgggccctagtccggtccttcccccgtggccaccccgttcccaccgacgacgcctacccg

SEQ ID NO: 43574 - DNA, 699 bp, Homo sapiens
  misc_feature: GYAE6OF02H2EW7.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccagggcaagggactggaggtgggtgctatttanactaatttgatggagaataaaaaattttacgcagactcgtagagggcgattcaccatctcagacgtacccttaccaaccatacgctagtactctaccaaatcgaacatggtagactagttagaagacaacggactaactttatagtttgtagacgaaagtagtttcggttggttacgagtactaatcaaagttggttaggaaggtttaggggtggtaccgttacggtaaccgtaacccgggttgggggtaacccgaaggggaaacccgtacgttcggggtaccctaacccgttccttccccgtaccgtaccgtcccttaccccgaacccggtaaacggggcccctaacggttccccgggttaccccgtttcccccccgtacgggtaccccttacccccgttacccccgtaacccgaaaccggtaccgacccgttaaccccggg

SEQ ID NO: 43575 - DNA, 714 bp, Homo sapiens
  misc_feature: GYAE6OF02FPT9J.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcccccccgttgaattcatcctcaggcactatggcatgcacgtgggtcccgccgacggccccagggcaagggactgggaggtgggtggctatttatactaatttgagtggaagtaaattaaaaaatttacgacagaccttccggtaggaacggggccgtattaccaacctatcctaccaagaccgtaccccttaccaacccataccgctagtactcctaccaaatcgaaacagtgggtacaacgtaggttacgaaacgaccgaacggtactaaactttattagttgtacgacgtaaagtagtttcggttaggttacgagactatacgtaaagtggttaggtaggtaggggttcggtaccgtaccgaccgtaccgggtcgggggaacccgaaggggtaacctaccggtcgggtacccgtacccgttccttcccgtaccgaccgtcccctaccgaaccgaaccgggtccctacggttcccggttccccttcccccgtacggtacccctaccccgtacccgtacccgaacggtaccgccctacccg

SEQ ID NO: 43576 - DNA, 630 bp, Homo sapiens
  misc_feature: GYAE6OF02H8UOD.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggctatttanacaatttgatggagaataaaaatttgcagactccgtgaagggccgattcaccatctcagacgacccttccaaccatacgctagtactctaccaaatagaacatggtgactagttgaaagacacggactaacttattatttgtagacgaaagtgtttacggttggttacgagactaatactaatggtaggagttagggtggccgtacgacgaccggtggggacccgaaggggaacctacgttcgggtcctaacccggttcctaccgtaccgacgtccctacccgaacccgacggggtcccctaacggttcccggttccctttaccccccgtggacccctaccccgtcccttacccgaacgtaccgccctaaccccgg

SEQ ID NO: 43577 - DNA, 565 bp, Homo sapiens
  misc_feature: GYAE6OF02HF449.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (355)..(355): a, c, t, g, unknown or other
  misc_feature (355)..(355): n is a, c, g, or t
  modified_base (496)..(496): a, c, t, g, unknown or other
  misc_feature (496)..(496): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanacaatttgatgganaattaaaaaattttcgcagactcgtagaaggccgattcacatctccagacacccttccaacatacgctgtatctacaaatgaacatggtnactagttagaagacacggactaactttattattgtagacgaaagtattcggttggttacgagtcaatacaagtgtaggagtagggtggctacgacaccgtggggaccagggaaccacgtggtaccaccgtctcctacgacnccctaccaccgaacggcccagtcccggtcctcccccgtggccctaccctcctaccaacgtcacctaccg

SEQ ID NO: 43578 - DNA, 731 bp, Homo sapiens
  misc_feature: GYAE6OF02HHAST.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccncaggccccaggcaagggctggagtgggtgctatttanactaatttgagtggacgtaattaaaaattttcgacacgactccgtaggaacggccgtattcaccatctaccagacgacccttaccaacactacgtctagtactctactaagtagaacctagtcggtagaactaggttacgaaacgtacgtaacggtactaaacgtttacgttaagtttcggtacgtaacggtaaacgttacgtttacggtttagggttacggtaacgtactaacgttacgtaaagttcggttaacgggtacggttaggggtcggtaccgttacggaaccgtaccgggttacggggaccgtaacggggtaaccgtaccgttacgggtaccgtaaccgttccgtacccgtacgaccgttaccccgaccgtaaccggtaccggtcccgtacgttcccggtacccgtttacccccggacgggtacccctaccccggttccctaacccggaacgtacccggtaccctaacccggg

SEQ ID NO: 43579 - DNA, 674 bp, Homo sapiens
  misc_feature: GYAE6OF02HRUUY.31.14.B03.1.454.CMB.1.raw
  modified_base (262)..(262): a, c, t, g, unknown or other
  misc_feature (262)..(262): n is a, c, g, or t
tcagcagtagacgtcacgaccggtgctcgatttagtgtgagtagtttgggctggagctgggttttcctcgttgctccttttaagacggtgtccagtcgtcaggttgcaccgtggtggaatctgggggaggcgtggtccggcctggggggtccctgagactctcctgtgccatgtcttgcgtctgaatttcatcctcaggcactatggcatgcacgtgggtccgccaggccccaggcaagggcgtggagtgggtgctatttanactaatttgactggaagaattaaaaaattttacgactaaggtaccttccgtaggaacgggcccgtagttccaccaatccgtacccgaaggtacgtaccccgttacccgaaccgtactaccgtcttagttaactcctacctaaagtcgaaactataggtatactaagttgaacgacacggtactaactttattaagttggtagacgaaagtatttcggttggtacgagtcaatcaaatgtaggtagtagggtcgctcgaactaccgtggggacctagggaactacgtggtaccaccgtctcctcgacgtccctacccgtaccgtaaccggggccctaacggtaccggttcccttacccccgtgggacccctaccccgttcccgtacccgaaacggtccgtaccctaaccccgg

SEQ ID NO: 43580 - DNA, 699 bp, Homo sapiens
  misc_feature: GYAE6OF02HLAIG.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggctatttatacaatttgatggagaataaaaattttacgacagactccgtgaagggccgattcaccatctccagacgaccccttaccaaccatacgctgtactctaccaaatgaacatggtgacagttgaagacacggacaactttattatttgtagacgtaaagtgtttcggtttagggttcgagtctaatacaaagttggtagggtagttagggggttggaccgttacggaaccgaccgggttggggggacccaagggggaaccctaacgtcgggttaccctacccggttccttacccgtccgtaaccggccccttaccccggaacccgtaaaccggggggcccccctaacgtttccccggggttaccccttttccccccccggtagggtaccccttaccccccgttcccgtttaacccccggaaacggtaccgtaccccgtaacccccggg

SEQ ID NO: 43581 - DNA, 569 bp, Homo sapiens
  misc_feature: GYAE6OF02FPI1J.31.14.B03.1.454.CMB.1.raw
  modified_base (400)..(400): a, c, t, g, unknown or other
  misc_feature (400)..(400): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccagggcccccaggccaagggactggagtgggtggcatttatacaatttgatggagataaaatttacgcagactccgtgaagggccattcaccatctccagagaccccttccaaccatacgctgtactctaccaaatgaacatggtgacagttgaagacacggcaacttattattgtgacgtaaanagttcgttggttcgagcatcaatggtgagtagggtggctcgacaccgtaggggccgaagggacacgtcggtaccaccgtcctccgtcacgccctaccgaccgaacgggcccacgtccggtcccttcccccgtcggccctacccctcctacccaacggtacgcctacccg

SEQ ID NO: 43582 - DNA, 574 bp, Homo sapiens
  misc_feature: GYAE6OF02IXWY3.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (462)..(462): a, c, t, g, unknown or other
  misc_feature (462)..(462): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagaattaaaaattttacgacagactccggtagaagggccgattcaccatctccgagacgaccccttaccaaccatacgctgtactcctaccaaatgaacagtggtagactagttagaagacacggacaacttattattagtgacgtaaagtagttcgttggttcgagtctatctaatggtgagtgggtcgctcgacncgtgggccagggacacgtggtaccaccgttctacctcacgcctccgacgacgggcccacgttccggtccttcccccgtggaccctaccctccgtcccaacgtcgccctaccg

SEQ ID NO: 43583 - DNA, 576 bp, Homo sapiens
  misc_feature: GYAE6OF02FK7VZ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccacggccccaggcaagggactggagtgggtggcatttatacaatttgatggagataaaaatttacgcagactccgtgaagggccattcaccatctccagacgacccttccaaccatacgctgtatctccaaatgaacatggtgacagttgaagacacggctaactttattattgtgacgtaaagtatttcgttaggttcgagctatcaatgtggatagggtgctcgacaccgtggggaccagggaacacgtggtcaccgtctcctcacgccctccaaccgaacgggtccccagttcccggttccctttccccccgtggccctaccccgttaccctacccgaacggtcgccctaaccccgg

SEQ ID NO: 43584 - DNA, 604 bp, Homo sapiens
  misc_feature: GYAE6OF02G8WWA.31.14.B03.1.454.CMB.1.raw
tcagcagtagacgtcacgaccggtgctcgatttagtgtgagtagtttggatttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagtagtgttttattcggccccacaataacaactacttagcttggtaccagcaagaaagtaggacacgcctacctaaactcctagactttacgtggtccttcgtacccgggctacgttcccggggttcctaaccggtattccagttcggcaggcgggtctcgggaccgtatttcacgtctcaccatcgagcacgcctgcgaggctgaacgatcgtggctagtttattactgtctagactaactatttaacttaccgtttctttcgtaccgttacgtttcgggacggtaacgggtaccgtaagggtcggacgtaacgtaccgtaaacggtacgtggtacggtgttacgaccctaaccgtacgttcgttacgttccttac

SEQ ID NO: 43585 - DNA, 623 bp, Homo sapiens
  misc_feature: GYAE6OF02ID05F.31.14.B03.1.454.CMB.1.raw
  modified_base (221)..(221): a, c, t, g, unknown or other
  misc_feature (221)..(221): n is a, c, g, or t
  modified_base (396)..(396): a, c, t, g, unknown or other
  misc_feature (396)..(396): n is a, c, g, or t
  modified_base (583)..(583): a, c, t, g, unknown or other
  misc_feature (583)..(583): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctggagactctcctgtgccatgtctgcgtctgaattcatccctcaggcactatggccatgcacgtggggtcccnccaggccccaggccaaggggactgggagtggggtggactattttagtactaattttgattggaagaattaaaaaattttacggactaagactcccgtagaagggccgattcaccatcctacagacgacccttcaaaccctatacgcttagtactctaccaaatgaactatggtanacgtagttagaacgacgtaacggactaaacgttattattgtagaacgaagtagtttcggttaggtacgaggactatacaagtgtaggagtaggggtgacctgaccgacgtggggaccaagggaacacgtgtaccgccgtctaccgcacgccctaccgacgacggtccacttcggtccccttccccgnggtcccctaccccgtcctaccgaacgtccgcctaacccgg

SEQ ID NO: 43586 - DNA, 534 bp, Homo sapiens
  misc_feature: GYAE6OF02IKS57.31.14.B03.1.454.CMB.1.raw
  modified_base (214)..(214): a, c, t, g, unknown or other
  misc_feature (214)..(214): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaaattttacgcagactccgtgaagggccgattcaccatctcagagacccttcaaccatacgctgtatctccaaatgaacatggtgacagttgaaagacaacggcaacttattattgtgacgaaagtattcgttggttcgagcatcaatgtaggatagggtgctcgacacctggggccagggaacacgtggtcaccgtctcctcacgcctccaccaagggcccatcggtccttccccnggccaccctcctccaagcgctaccg

SEQ ID NO: 43587 - DNA, 738 bp, Homo sapiens
  misc_feature: GYAE6OF02GKJ9R.31.14.B03.1.454.CMB.1.raw
  modified_base (234)..(234): a, c, t, g, unknown or other
  misc_feature (234)..(234): n is a, c, g, or t
tcagcagtagacgtcacgaccggtgctcgatttagtgtgagtagtttgggactgagacggtgggttttccgtcgttgctccttttaacgagggtgtccagtgtcagggtgcacctgggtcggaatctggggaggcgtggtccgggcctgggggtccctgaggactctccgtgtgccagtgtcctgcgtctgaattcactcctcaggccactatcggcactcgcactgggtcccncctaggccccaggcaacggggactagggacgtgggtggccattttagaccgaattttaggagtaggaagtaattaaaaaagttttcgactaagtaccttccggttaggaaaggggtccgtaatttccaaccaactaacctaccgaacgaacggaccccctttaaccaacctataaccgtcctgtatcctaccaaatcgaaactagtaggtcgacctagttacgaagtaccacggactaacgtttattactttggtacggacgtaaagttcttttacggttgttaccgagctaatcgaattggtagggagtagggtcggactacgacaccggttggggacccaaggggtaacctacgttcgggttacctaccgtaccttaccgtacgtacgacccgttacccaccggtaaccgggtcccctaagtttcccgggttccccgttcccccggttacggacccgtaccccgttacccgtacccgaaacggtccgacccttaaccccggg

SEQ ID NO: 43588 - DNA, 576 bp, Homo sapiens
  misc_feature: GYAE6OF02F2AA0.31.14.B03.1.454.CMB.1.raw
  modified_base (253)..(253): a, c, t, g, unknown or other
  misc_feature (253)..(253): n is a, c, g, or t
  modified_base (363)..(363): a, c, t, g, unknown or other
  misc_feature (363)..(363): n is a, c, g, or t
  modified_base (496)..(496): a, c, t, g, unknown or other
  misc_feature (496)..(496): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaattaaaaaattttacgacagactccgtgaagggccgattcaccatctccagacgaccccttccaaccatacgctgtatctcaaatgaacatggtnactagttagaagacacggactaactttattattgtagacgtaaagtagtttcggttggttcgagctatcaatggtaggagtaggggtgctcgacaccggtggggccaagggacacgtggtccaccgtctcctnacgccctaccaccgaacgggcccagtcccggtcccttccccgtggccctacccctccctaccgaacgacgccctacccgg

SEQ ID NO: 43589 - DNA, 555 bp, Homo sapiens
  misc_feature: GYAE6OF02FGFI2.31.14.B03.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccagggccccaggcaagggactggagtgggtggcatttatacaatttgatggagattaaaaaatttacgcagactccgtgaagggccgattcaccatctccagacgacccttcaaccatacgctgtatctccaaatgaacatggtgacagttgaagacacggctaacttattatgtgacgaaagatttcgttggttcgagcatcaatgtggataggggtgctcgacaccgtggggccagggaacacgtggcaccgtctccgtcacgccctccaccgaacgggccctagtcccggttcccttcccccgnggccctacccctacctcccaagccgcctacccg

SEQ ID NO: 43590 - DNA, 555 bp, Homo sapiens
  misc_feature: GYAE6OF02G9V18.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagataaaaattttacgcagactccgtgaaggccgattcaccatctccagagacccttcaaccatacgctgtatctccaaatgaacatggtgacagttgaagacacggcaacttattattgtgacgaaagtattcgttggttcgagctatcaatgtaggatagggtgctcgacaccgtggggccagggaacacgtggtcaccgttctcctcacgcctccgaccaacgggcccagtccggtccttcccccgtggccctaccccgtccctaccaacggccgtacctaccccgg

SEQ ID NO: 43591 - DNA, 529 bp, Homo sapiens
  misc_feature: GYAE6OF02HRG0S.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttanacaatttgatggagataaaaaattttacgcagatccgtgaagggccgattcaccatctccagagaccttcaaccatacgctgtatctccaaatgaacatggtgacagttgaagacaacggcaacttattattgtgacgaaagtattcgttggtcgagcatcaatgtggatagggtgctgacaccgtgggccaagggacactggcaccgtctcctcagcctccaccaggcccagtccgtccttccccgnggccaccctcctccgaancgcctacccg

SEQ ID NO: 43592 - DNA, 656 bp, Homo sapiens
  misc_feature: GYAE6OF02ICSNZ.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtgcatttanacaatttgatggagaataaaaatttacgcagactccgtgaggccgatcacatctcagacgaccctcaaccatacgctgtaactctaccaaatcgaactatggtagaactagttagaaacgtacgaacggactaaactttattactttagtagtacgaaagtagtttcggtttaggttacgagtactattacaagttgtaggtaagttaaggggtggtaccgtacgtaaccgaccgggttacggggacccgtaaggggaacctacgttcggtaccgtacccgtccgtccctacaccggccctacccgaaccgaaccgggcccctaacggttcccggtcccctttaccccccgtgggacccctacccccgtaccctaacccggaacgtccgacccgtaccccgg

SEQ ID NO: 43593 - DNA, 549 bp, Homo sapiens
  misc_feature: GYAE6OF02F5S9O.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaaattttacgcagactccgtgaagggccgattcaccatctccagacgacccttccaaccatacgctgtatctaccaaatgaacatggtgacagttgaagacacggacaacttattattgtgacgaaagntttcgttggttcagcatcaatgtggatagggtgctcgacacgngggccagggacncgtggtcnccgtctcctcacgcctccaccgaacgggccctagtccggtacttcccccgtggacccacccctccctaccaacggcncctacccgg

SEQ ID NO: 43594 - DNA, 574 bp, Homo sapiens
  misc_feature: GYAE6OF02GMJVI.31.14.B03.1.454.CMB.1.raw
  modified_base (254)..(254): a, c, t, g, unknown or other
  misc_feature (254)..(254): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagataaaaattttacgcagactccgtgaagggccgattcaccatctccagacgacccttccaaccatacgctgtatctaccaaatgaacatggtagacagttgaagacgacggactaactttatttattgtagtacgaaagtatttcgttggttacgagcatacaatgtaggagtagggtgctcgacaccgtgggccagggactacgtggtacaccgtctcctcgagccctaccaccgacgggtccccagttccggtccctttcccccgnggccctacccctcctacccaacggtacgcctaacccgg

SEQ ID NO: 43595 - DNA, 553 bp, Homo sapiens
  misc_feature: GYAE6OF02JZ2EQ.31.14.B03.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggagcgtggtccggcctgggggtccctgagactctcctgtgccatgtctgcgtctgaattcatcctcaggcactatggcatgcactgggtccnccaggccccaggcaagggctggagtgggtgcatttanacaatttgatggagataaaaatttacgcagactccgtgaaggccgattcaccatctccagagacccttccaaccatacgctgtatctacaaatgaacatgtgacagttagaagacacgactaacgttattattgtagacgaaagtatttcggttggttacgagtcatacaagtgtaggatagggtgactcgacacgtgggccagggacncgtggtcaccgtctcctnacgtcctaccgacaacgggccctagtccggtaccttcccccgtggccctacccgtcctaccaacgtacgccctacccg

SEQ ID NO: 43596 - DNA, 605 bp, Homo sapiens
  misc_feature: GYAE6OF02IJQ5L.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccaggcaaggggactgggaggtggggtggcatttatactaatttgatggagaataaaaattttacgcagactccgtagaagggccgattcaccatctccagacgacccttccaaccataccgctagtactctaccaaaatgaacatggtagactagttagaagacgaacggactaaactttattaattggtagacgaaagtactttggttcggttcgagtctaatactaagtgtaggagttagggtggtactcggaacaccggtggggacccaaggggaacctacgtcggtacctacccgtcctcctccgacgtccctccaaccgacggccctacgtccggtccttccccgcgcccaccctcctacccaacgccgactacccg

SEQ ID NO: 43597 - DNA, 683 bp, Homo sapiens
  misc_feature: GYAE6OF02J15XF.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactggagtgggtggcatttanacaattgatggagaataaaaatttacgcagactcgtagaaggccatcacatctcagacaccctccaaccatacgctgtactctacctaaatcgaactagtggtacgacgtagttagaacgacaacggactaaacttacttagttgtacggacgtaaagtacgtttcggttagggttacgtagtactatactaaagtggtaggtagtaggggttcgcctacggaccgtaccggtcggggaccgaacggggaccaccgttcgggtaccctaacccggttccttacccgtacgtaccgacccctacccgaacccggaacccggggtcccctaacggttccccgggttaacccccttttccccccggtagggtaccccctaccccccgttaccccgtaaccccggtaaccgaccggtacccctaaccccgggg

SEQ ID NO: 43598 - DNA, 584 bp, Homo sapiens
  misc_feature: GYAE6OF02H1BEY.31.14.B03.1.454.CMB.1.raw
  modified_base (214)..(214): a, c, t, g, unknown or other
  misc_feature (214)..(214): n is a, c, g, or t
  modified_base (476)..(476): a, c, t, g, unknown or other
  misc_feature (476)..(476): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcacgtgggtccnccaggccccaggcaagggctgggagtgggtgcatttatacaatttgatggagataaaaaattttacgcagactcgtgaaggcgattcaccatctccagacgaccttccaaccatacgctgtatcctacaaatgaactatggtagactagttagaagtacaacggactaaactttattattgtgacgaagtatttcggttggttcgagtcgatacaattgtaggtagtaggggtgaccttcgacaccgtggggccagggaacncgtggtccaccgtctcctcgacgacctccgaaccgacgggcccacgttccgggtacccttcccccgtggccctaccccgttccctaccgaacggtaccgcctacccgg

SEQ ID NO: 43599 - DNA, 674 bp, Homo sapiens
  misc_feature: GYAE6OF02IWPMS.31.14.B03.1.454.CMB.1.raw
  modified_base (586)..(586): a, c, t, g, unknown or other
  misc_feature (586)..(586): n is a, c, g, or t
  modified_base (644)..(644): a, c, t, g, unknown or other
  misc_feature (644)..(644): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggccccaggccgaaagggactgggaggtggggtcggctagtttaatacgtaatttgatggaagaattaaaaaactttcgacagacctccggtgaaaggggccattaccaccatcctaccacgacgtaccccttacccaacctaataccgtcttagttactacccgtaaccaaagtacgaaacctagttagggtacgaactaaggttacgaacggtaaccgacggacttaaacgttatttagtcgtacggtacgtaaagtcgttttacggttgggttacgagtacattacaaagttggtaggtacgttagggtcgctcgaccgtcggacggggactaacgggactacgtcggtacctaccgtcttccncgaacgtcccgacccgaccgacgggccctagttccggtccccttacccgcggtacccncccgtacctacaaccgtcgacccgtaccgg

SEQ ID NO: 43600 - DNA, 582 bp, Homo sapiens
  misc_feature: GYAE6OF02GM4K5.31.14.B03.1.454.CMB.1.raw
  modified_base (254)..(254): a, c, t, g, unknown or other
  misc_feature (254)..(254): n is a, c, g, or t
  modified_base (565)..(565): a, c, t, g, unknown or other
  misc_feature (565)..(565): n is a, c, g, or t
  modified_base (574)..(574): a, c, t, g, unknown or other
  misc_feature (574)..(574): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagaataaaaaattttacgacagactccgtagaagggccgattcaccatctccagacgaccccttaccaaccatacgcttgtatcctaccaaatgaacatggtgactagttagaagacacggacaactttattattgtgacgtaaagtatttcggttggttcgaagcatacaatggtaggtagtagggtgctacgactaccgtggggaccaggggaacctacgtcggtccaccgtcctcctacacgccctaccaccgaacgggcccagttcccgtcccttccccctgaccctccctcccnccgaacgcncctacccg

SEQ ID NO: 43601 - DNA, 898 bp, Homo sapiens
  misc_feature: GYAE6OF02G7MHZ.31.14.B03.1.454.CMB.1.raw
tcagcagtagacgtcacgaccggtgctcgatttagtgtgagtagtttgggtcgtgagctgggttttccgtcgttcgccctcgttttaagaggttgtccgagttgtctagggtgcacctgggtgggaaatcgtgggggaggacgtggtcccggccgtggggggtcccttggagactctcctggtgtcctatggtctgtacgtctgaattcatcctcaggctacgtagtggctaggtcgcctacggtcggggtcccgggccgacggccccgagggccgaacgggtccttggggaggtcggggtcgtcctaagtttaacgttaacgttaagtttgatagggaagtaaacttaaaaaagttttacggacgtaacggtacccgtcccggtagggaaccgggtcccgtaagttaccgacctagtccgtaccggaacgaccgtacccctttaccaaccgtacgtaccgtacgttggtactacccgtaacctaaagtacgtaaacgtagttcgggtacgtaaacgtacggttaccgaaaggaaccggtaacccggttacctaaacgtttagttaaccgttgtacgaacgtaaagttacgtttacgggttacggtacgacgtactaacgtaccgtaagttacggtaagggtacgtaggggtccgtaccgtaccgggaacgtacccgggtacggggaacccgaacgggtaacccgtccgttacggtaacccgttaccggtttccttacccggtaacccgacgttaccccgtacccgaaccgggtaaacccggggtacccccggtaccgggttccccggttacccccggttacccccggtaccggacccccgttaccccggttaccccggtaaccgggaaccgtacccgggtacccgttaacccccggg

SEQ ID NO: 43602 - DNA, 549 bp, Homo sapiens
  misc_feature: GYAE6OF02FVWG0.31.14.B03.1.454.CMB.1.raw
  modified_base (396)..(396): a, c, t, g, unknown or other
  misc_feature (396)..(396): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagaccttccaaccatacgctgtatctcaaatgaacatggtgacagttgaagacacggcaacttattattgtgcgaaagtntttcgttaggttcgagtcatcaatgtaggatagggtgctcgacaccgtgggccagggacacgtggtcaccgtctctcacgcctccaccgacgggcccagtccggttcccttcccccgtggaccctaccccgtcctcccaacggcgcctacccg

SEQ ID NO: 43603 - DNA, 593 bp, Homo sapiens
  misc_feature: GYAE6OF02G77GF.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactgggagtgggtggctatttatacaatttgatggagaataaaaattttcgcagactccgtgaagggccgattcaccatctccagacgaccccttccaaccataccgctgtatcctaccaaatgaacatggtgacagttgaagacacggactaacttattatttgtagacgaaagtattcgttaggttcgagcatcaatgtaggatagggtgctcgacaccgtgggccagggaaccacgtcggtcaccgttctccctcgaacgtccctaccgaacccgtaacgggcccctaacgttcccggttccctttaccccccgtggaccctaccccttcccgtacccaacggtccaccctacccgg

SEQ ID NO: 43604 - DNA, 716 bp, Homo sapiens
  misc_feature: GYAE6OF02I780I.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggctatttatactaatttgagtggaagtaaattaaaaatttacgacaagactcggtaggaacgggcctattaccacctatcctaccgagaccgtaccccttaccaacctataccgtctagtactacctacaaatcgaactagtggcactagttagaagacacgactaactttattagttagtagacgtaaagttacgtttcggttaggttacgagtactatacgtaagtggtagggtaagttaggggttcggtacctaccggtaacccgtaccgggtcgggggaccaaacgggggtaacctacggttacggtacccgtacccgtttcctcccgttacgaccgtcccctacccgaacccgggtaaccgggccccttaaccggtttcccggttacccccgtttcccccggtacgggtaccccctacccccgttcccgttaacccggaaacggtcccgtaccccttaacccggg

SEQ ID NO: 43605 - DNA, 609 bp, Homo sapiens
  misc_feature: GYAE6OF02H41FZ.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (418)..(418): a, c, t, g, unknown or other
  misc_feature (418)..(418): n is a, c, g, or t
  modified_base (569)..(569): a, c, t, g, unknown or other
  misc_feature (569)..(569): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggaagaataaaaaattttacgcagactccgtgaagggccattccacatctccagacgacccttaccaaccatacgctagtactctaccaaatgaaacatggtgaactagttagaaacgacacggactaactttattactttgtagacgtaaaagtntttacggtttggttacgagcatacaagttggtaggagttaggggtcgcctacgacaccgtggggaccgaagggaccacgttcggtacctaccgtctcctacgacgccctaccgaccgtaacgggccctaacgttccggtcccttaccccgnggccctaccccgtcctacccaacggtccgaccgtacccgg

SEQ ID NO: 43606 - DNA, 614 bp, Homo sapiens
  misc_feature: GYAE6OF02H20WT.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccagggcaagggactgggaggtggggtggctatttatactaatttgatggaagaataaaaaattttacgcagactccgtgaagggccgattcaccatctccagacgacccttccaaccatacgctgtatctaccaaatgaaactatggtagacagttgaagacacggactaaactttattatttgtagacgtaaagtatttcggtttaggttacgagctaatcaatggtaggagttagggtggctcgacaccggtggggaccaagggaacacgttcggacctaccgttctcctcgacgtccctaccaaccgaacgggccctacggttcccggtcccttcccccgtcggtaccctaccccgtacccttacccgaaacgccgtacctaaccccgg

SEQ ID NO: 43607 - DNA, 652 bp, Homo sapiens
  misc_feature: GYAE6OF02HRZ2D.31.14.B03.1.454.CMB.1.raw
  modified_base (256)..(256): a, c, t, g, unknown or other
  misc_feature (256)..(256): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactgggagtgggtggctatttanacaatttgatggaagaattaaaaaattttacgcaagactccgtaggaagggccgattccaccatctccagacgaccctccaaccatacgctgtatctaccaaatgaacatggtanactagttagaagacacggactaacttattattagtgacgaaagtatttcggttggttacgagtcatactaagtggtaggtaattaggggtgccttacggacctaccgggtggggacccgaagggaaaccctacgttcgggtaccacccgttccgtacctaccgaccgtccctacccgaaccggaaccggggcccctaacggttcccgggttcccctttcccccccgtagggccccctacccccgttacccgtacccgaacggtacccgacccgtaccccgg

SEQ ID NO: 43608 - DNA, 601 bp, Homo sapiens
  misc_feature: GYAE6OF02IO6PW.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgaggactctcctgtgccatgtctgcgtctgaattcatcctcaggcactatggcatgcactgggtccgccaggccccaggcaagggactgggagtgggtggcatttatacaatttgatggagaattaaaaaattttacgacagactccgtagaagggccgattcaaccatctccagacgaccccttccaaccatacgctgtatctaccaaatgaacatggtagactagttagaagacacggactaaactttattatttgtagacgaaagtattcggttggttacgagtcatacaatggtagagtagggtgctacgacaccgtggggaccagggaacctacgtcggtaccaccgtctccgtccacgccctaccgaaccgaacggggcccctaacgtccggttaccctttcccccgtggcccctaccccgtcctacccgaacgtcgcctaacccgg

SEQ ID NO: 43609 - DNA, 667 bp, Homo sapiens
  misc_feature: GYAE6OF02FEKH7.31.14.B03.1.454.CMB.1.raw
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtcccgccaggccccaggcaagggctggagtgggtggcatttanacaatttgatggagtaattaaaaatttcgcagactccgtagaaggccattcaccatctaccagacgacccttacaaccatacgctagtatctacaaatgaactatggtagacgagttagaagacacggactaacgtttattatggtagtacgtaaagtagtttcgttagggtttcgagctaattacaaagttgggtaggtacgttaggggtcgcctaccggtaaccgtacccggttagggggaccaagggggaacctaccgtttacgggtaccctacccggttccctcccgttaccaccggtaccccttacccgaaacccgaaccgggggtccccctaaggttccccgggttcccctttcccccccgtagggaccccctaccccgtacccctaccgaacggacgcccgtaacccgg

SEQ ID NO: 43610 - DNA, 603 bp, Homo sapiens
  misc_feature: GYAE6OF02IGL0H.31.14.B03.1.454.CMB.1.raw
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggagtgggtgcatttanacaatttgatggagataaaaaattttacgcagactccgtgaagggccattcaccatctccagacgacccttccaaccatacgctgtatctaccaaatgaacatggtgacagttgaaagacaacgactaacttattattgtagacgtaaagtatttcggttggttcgagtcatcaattgtaggtaagtaggggtggacttccgaacgacccgtgggggacccaaggggaaccacgttgggtaccaccgttcctcctcacgccctaccaacccgaacgggccctaacgttcccggtccctttcccccgtcggccctaccccttcccgtacccaaacggtccgacgtaaccccgg

SEQ ID NO: 43611 - DNA, 551 bp, Homo sapiens
  misc_feature: GYAE6OF02GLQWR.31.14.B03.1.454.CMB.1.raw
  modified_base (459)..(459): a, c, t, g, unknown or other
  misc_feature (459)..(459): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactccgtgaagggccgattcaccatctccagacgacccttccaaccatacgctgtatctccaaatgaacatggtgacagttgaagacacggactaacttattagttgtgcgaaagatttcgttggttacgagcatcaatgtaggatagggtgctgacaccgtggggcagggaacncgtggtcaccgtctcctcacgccctaccaccgaacgggcccacgttccggtaccttcccccgtggcccaccctcctccaacgcgcctacccg

SEQ ID NO: 43612 - DNA, 559 bp, Homo sapiens
  misc_feature: GYAE6OF02IIGN7.31.14.B03.1.454.CMB.1.raw
  modified_base (254)..(254): a, c, t, g, unknown or other
  misc_feature (254)..(254): n is a, c, g, or t
  modified_base (408)..(408): a, c, t, g, unknown or other
  misc_feature (408)..(408): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttanacaattttgatggagataaaaaattttacgcagactccgtgaagggccgattcaccatctccagacgacccttccaaccataccgctgtatctaccaaatgaacatggtgacagttagaagacacggactaacttattatttgtagcgaaagtnttcgttggttcgagtcatcaatgaggtagtagggtgctcgacaccgtgggaccagggacacgtggtcaccgtctcctcacgcctaccaccgaacgggcccagtccggtcccttcccccgtggcccacccgtccaccaacgccgcctacccg

SEQ ID NO: 43613 - DNA, 560 bp, Homo sapiens
  misc_feature: GYAE6OF02HYY7Z.31.14.B03.1.454.CMB.1.raw
  modified_base (526)..(526): a, c, t, g, unknown or other
  misc_feature (526)..(526): n is a, c, g, or t
tcagcagtagacgtcacgaccggtgctcgatttagtgtgagtagtttgggctgagctgggtttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaattttacgcagactcgtgaaggccgattcaccatctccagacgaccttaccaaccatacgctgtatctccaaatgaacatggtgacagttagaagacacggcaacttattattgtgacgaaagtattcgtttggttcgagcatcaatgtggagtagggtggctcgacaccgtggggccaagggaacacgtggtccaccgtcctcctcacgccctaccgaccgaacgggcccagtccggttcccttcccccgnggcccaccctccctacccgaacgacgcctacccg

SEQ ID NO: 43614 - DNA, 558 bp, Homo sapiens
  misc_feature: GYAE6OF02GJ4SK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcagggactggagtgggtgcatttatacaatttgatggagataaaaaattttacgcagactccgtgaagggccattcaccatctccagagacccttccaaccatacgctgtatctccaaatgaacatggtgacagttgaagacacggacaactttattattgtagacgaaagatttcgttggtttcgagtcatcaatgtggatagggtgctcgacaccgtgggccagggacactggtccaccgtctcctcacgccctaccaccgacgggcccagttcccggtcccttcccccgtggcccaccccgttccctaccgaacgtacgcctaacccgg

SEQ ID NO: 43615 - DNA, 846 bp, Homo sapiens
  misc_feature: GYAE6OF02JK7T2.31.14.B03.1.454.CMB.1.raw
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgcaggccccaggcaagggactggagtgggtggcatttanacaatttgatggagataaaaatttacgacagactccgtgaacggccgattcaccatctccagacgacccttacaaccatacgctagtactctaccaaatcgaaactacgtaggtacgaacgtaaggttacgaaagtaaccgtaaccgggtactaaaaccgttttaagtttaagttttacggttacgtaacccggtaaaaggtaacgttttaccgggttttaaggggttaccggttaaggtaccgtaaagttaccgtaaaagtttgggttaacggggttaaagtttaacggggggtttacggtacccggttaacggtaaacccgtaacccgggtttacggggggaaccccggtaaacggggtaaaccggtaacccggtttaggggttaccccgtaaaccccgggtttccccgttaccccgttacccggaacccggtacccccttaccccggtaaacccgtaacccgggggtacccccgtaaaccgtttccccggggtttacccccttttacccccccggtaccgggttacccccgtaacccccccgtttacccgtaacccccgtaaacccggtacccgtccccgttaacccccggg

SEQ ID NO: 43616 - DNA, 619 bp, Homo sapiens
  misc_feature: GYAE6OF02HQO63.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggcatttatacaatttgatggagaataaaaattttacgacagactccgtgaagggccattcaccatctccagacgacccttccaaccatacgctgtatctaccaaatgaacatggtgactagttagaagacacggctaacttattattgtagacgtaaagtatttcgttggttcgagtactatctaaagttgtagggtaagttaggggtggtccgtacggaacctacccggtagggggacccgaaggggaaccacgttcgggtaccacccgttcctcctacgacgtccctacccgaaccgaacgggcccctacgttccggttcccttcccccgtggcccctaccctcccgtacccaacgtccgacctacccgg

SEQ ID NO: 43617 - DNA, 547 bp, Homo sapiens
  misc_feature: GYAE6OF02I0G0C.31.14.B03.1.454.CMB.1.raw
  modified_base (361)..(361): a, c, t, g, unknown or other
  misc_feature (361)..(361): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctccagtgccatgtctgcgtctgaattcatcctcaggcactatggcatgcactgggtccgccaggccccaggcaagggactgggagtgggtggcatttatacaatttgatggagataaaaaattttacgacagactccgtgaagggccgattcaccatctccagagacccttccaaccatacgctgtatctccaaatgaacatggtnacagttgaagacacggcaacttattatttgtgacgaaagtattcgttggttcgagcatcaatgtggatgggtgctcgacaccgtgggccagggacncgtggtcaccgtctcctnacgcctccaccacgggcccactccggtccttcccccgtggccctacccttccncccgaacgcgcctacccgg

SEQ ID NO: 43618 - DNA, 585 bp, Homo sapiens
  misc_feature: GYAE6OF02I6XOG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggctatttatacaatttgatggagataaaaattttacgcagactccgtagaagggccgattcaccatctccagacgacccttccaaccatacgctgtatcctaccaaatgaacatggtgacagttgaagacacggctaaacttattatgtgacgaaagtattcgttggttccgagctatacaatgtaggagtagggtgctcgacacgtcggggaccagggaccacgtcggtacaccgttctcctcacgccctacccgaccgaacgggcccctaggtcccggtccttacccccgtcgggaccctaccccgtcccttacccaaacggccgtcccgtaacccgg

SEQ ID NO: 43619 - DNA, 642 bp, Homo sapiens
  misc_feature: GYAE6OF02IHJDC.31.14.B03.1.454.CMB.1.raw
  modified_base (363)..(363): a, c, t, g, unknown or other
  misc_feature (363)..(363): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggctggggggtccctgagactctcctgtgccatgtctgcgtctgaattcatcctcaggcactatggcatgcacgtgggtcccgccaggccccaggccaagggactgggagtgggtggcattttatacaatttgatggagtaataaaaattttacgcagactccgtagaaggccgattcacatctcagacgacccttcaaccatacgctgatctaccaaatgaacatggtanacagttagaagacgcgactaaacttattattgtagacgaaagtatttcggttggttacgagtactattacaaagttggaggtaagttaaggggtcggtaccgtacggacctaccggtgggggaccctaaagggaacctacgttcggtaccgtaaccgttcctaccgtaccgacgtaccctacccgaaccggaccgggtccccaacggttcccggtaccctttcccccgacggtccccaccccgttacccgtacccgaacgtcccgaccttaaccccggg

SEQ ID NO: 43620 - DNA, 588 bp, Homo sapiens
  misc_feature: GYAE6OF02ID7HY.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggctgggagtgggtggctatttanactaatttgatggagaataaaaattttacgcagactcgtagaggccgattcaccatctaccagacgacccttccaaccatacgctagtactctaccaaatgaacatggtacactagttagaagacaacggactaacttattattgtagacgtaaagtatttcggttgtacgagtcatacaagtgaggtagtagggtgctcgacgacgtggggaccagggaacncgtcggtcaccgtcncctcgacgccctaccgacgaccgggccctacgttccggtcccgttcccccgtggcccctaccccgtccctacccgaacggtaccaccctacccgg

SEQ ID NO: 43621 - DNA, 533 bp, Homo sapiens
  misc_feature: GYAE6OF02F9DFA.31.14.B03.1.454.CMB.1.raw
  modified_base (392)..(392): a, c, t, g, unknown or other
  misc_feature (392)..(392): n is a, c, g, or t
  modified_base (503)..(503): a, c, t, g, unknown or other
  misc_feature (503)..(503): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtggcatttatacaatttgatggagataaaactttacgcagactccgtgaagggccattcaccatctcagagacccttccaaccatacgctgtatctccaaatgaacatggtgacagttagaagacacggcaacttattattgtgcgaaagntttcgtggttcgagcatcaatgtggatagggtgctcgacaccgtgggccaggacacgtggtcaccgtctctcacgcctccaccgacgggcccagtccggtcccttccccgnggcccaccctcctccaacgcgcctacccgg

SEQ ID NO: 43622 - DNA, 545 bp, Homo sapiens
  misc_feature: GYAE6OF02F0XPJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttcgcagactccgtgaagggccgattcaccatctccagacgacccttccaaccatacgctgtatctccaaatgaacatggtgacagttgaagacacggcaaactttattattgtgacgaaaagtatttcgttggttacgagcatcaatgtggataggggtgctcgacaccgtggggccagggacacgtggtcacgtctcctcagccctccaccgaacggcccatccggtccttcccccgtggcccaccctccctccaagcgctacccg

SEQ ID NO: 43623 - DNA, 586 bp, Homo sapiens
  misc_feature: GYAE6OF02GCQ2G.31.14.B03.1.454.CMB.1.raw
  modified_base (538)..(538): a, c, t, g, unknown or other
  misc_feature (538)..(538): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatcctccagacgacccttccaaccatacgctgtatctaccaaatgaacatggtgacagttgaagacacggacaacttattattgtagacgtaaagtatttcggttaggtttcgagctatcaatgtggagtagggtggctcgactccgtggggccagggacacgtggtacaccgtctcctcgagccctccaccgaacgggcccctaagttcccggttcctttccccccgngggtccccaccccgttccctacccaaacggtaccgaccctaaccccgg

SEQ ID NO: 43624 - DNA, 562 bp, Homo sapiens
  misc_feature: GYAE6OF02F2URG.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggcatttanacaatttgatggagataaaaaattttacgcagactccgtgaagggccgattcaccatctccagagacccttccaaccatacgctgtatctccaaatgaacatggtgacagttgaagacacggcaacttattattgtgcgaaagatttcgttggttcgagcatcaaatgtaggatagggtggcgtcgacaccgtggggaccagggacacgtggtcaccgttctcctcacgccctccaccgaacgggcccaacgttccgggtccctttcccccgtggccaccccgttcctaccctaacgacgcctaacccgg

SEQ ID NO: 43625 - DNA, 677 bp, Homo sapiens
  misc_feature: GYAE6OF02J0N45.31.14.B03.1.454.CMB.1.raw
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctgggggtccctgagactctcctgtgccatgtctgcgtctgaattcatcctcaggcactatggcatgcatgggtccgccaggccccaggcaagggactggagtgggtggctattanacaatttgatggagaataaaaattttcgacagtactccgtaggaacgggccagttacaccatcctaccaagacgtaccccttcaaccatacgctagtactctaccaaatcgaactacgtgggtanactagttacgaaagtacacggactaacgttattatttagagacgaagtagttcggttaggttcgagtacagtctaagtggtggaattaggggcgtcgtacgaccgaccggttcggggaccgaaggggtaccaacggttggtacccgtaacccggttccttcccgaccgaccgtaccccgttcccgaaccgtaaccggggccccgtaacgtttcccgggttacccctttccccccggtacgggacccccctacccgttccccgttaaccccgaaacggttaccgggaccccttaaccccgggg

SEQ ID NO: 43626 - DNA, 655 bp, Homo sapiens
  misc_feature: GYAE6OF02JZZ36.31.14.B03.1.454.CMB.1.raw
  modified_base (261)..(261): a, c, t, g, unknown or other
  misc_feature (261)..(261): n is a, c, g, or t
tcagcagtagacgtcacgaccggtgctcgatttagtgtgagtagtttggtcgtgagcgtggtttccgtcgttgcgtctttaagaggtgtcagtgtcaggtgcacctggtggaatcgtggggaggcgtggtccggctgggggtccctgagactctcctgtgccatgtctgcgtctgaattcatcctcgaggcactatggcatgactacgtgggtcccgaccaggcccccaggaccgaagggtctggagtgggtgctatttanacaatttgatggagaataaaaactttcgctagactcgtgaaggcctattcgacatctccagacgacccttaccaaaccagtaccgctagttatacctccgaaaatgaaacatggtagacctaggttacgaagacgacgactaaactttattaatggtagaccgtaaagtacgtttcggtttaggtacaagtcaagttacaaagtgtggtaaccgttaggggtcgcgttaccgaacgacccggttggggacccgaaagggtaaccgtaaccgttgggtaaccctaaccggttcctaccgttacaaccgggtcccctaccgaaccgtaacgggccccctaagttccgtcccttaccccgtggccctacccctccgtacaagacccgcctaacccgg

SEQ ID NO: 43627 - DNA, 589 bp, Homo sapiens
  misc_feature: GYAE6OF02GHJ6A.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtggcatttanacaatttgatggagaattaaaaaattttacgacagactccggtagaacgggccgattcaccatctccagacgacccttccaaccatacgctgtactcctaccaaatcgaacagtggtagactagttagaagacacggactaactttattattgtgacgtaaagtctttcgttggttcgagctatcaatgtaggagtagggtgctcgacaccgtggggaccagggacacgtcggtctaccgtctccctcgacgtcccgtccaaccgacgggccctaagtccggtacccttcccccgtggaccctaccccttccgacccgaagaccgtccctaacccgg

SEQ ID NO: 43628 - DNA, 553 bp, Homo sapiens
  misc_feature: GYAE6OF02F9ELI.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggctatttatacaatttgatggagataaaaaattttacgcagactccgtgaagggccgattcaccatcctccagacgacccttccaaccatacgctgtatcctaccaaatgaacatggtgactagttgaagaccacggacaactttattattgtgacgaaagatttcgttggttacgagcatacaatgtggatagggtgctcgacaccgtgggccagggacacgtgtcacccgttctcctcacgccctaccaccgacgggcccagtccggtcccttcccctggaccctccctcctccagacgctacccg

SEQ ID NO: 43629 - DNA, 642 bp, Homo sapiens
  misc_feature: GYAE6OF02IX2QX.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgctatttanacatttgatggagaataaaaattttacgcagtactcgtaggacggctattccacatctaccagacgtacccttaccaacactacgctgtactctacaaatacgaacagtggtanacgtagtagaagacacggactaacttattagttagtgaacgaaagtacgtttcggtttaggttacgacgatactacgtaagtggtaggtagttagggtcgctaccgactaccggtcgggacgaacgggacctacgtcggtaccgtaccgttctacccgtacgacgtaccctaccgaacccggaaccgggtccctaacggttcccggttaccccgtttccccgtacggacccctaccccgttcccgaaccgtaaccggtccgtacctaccccggg

SEQ ID NO: 43630 - DNA, 749 bp, Homo sapiens
  misc_feature: GYAE6OF02IK4XM.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggctggggggtccctgagactctcctgtgccatgtctgcgtctgaattcatcctcaggcactatggcatgcacgtgggtccnccaggccccaggcaagggctgggagtgggtgcatttanacaatttgatggagaataaaaaattttacgcagactccgtagaagggccgtattcaccatctacagacgacccttccaaaccatacgctgtactctaccaaatagaactatggtagacagttagaaagacaacggactaacgttattagttgtagacgtaaagtagtttcggtttaggttacgagtccgtaattaccgaaagttcggttaggtaaggttacggggttagggtacccgttaccgggaacccttaacccgggttaggggggaccccgtaaaacggggggtaaccctaaaaccgggtttccggggttaacccgttaaaccccggttcccgttacccgtttaacccggaaccgtccccgttaaccccgaaacccggtaaccggggtacccccctaacgggttcccggtttcccccgtttaccccccgtacgggtacccctaacccccgttccccgttaacccgtaacgaccggtaccccttaaccccgggg

SEQ ID NO: 43631 - DNA, 533 bp, Homo sapiens
  misc_feature: GYAE6OF02GTBQ9.31.14.B03.1.454.CMB.1.raw
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttanacgaatttgatggagataaaaatttcgcagactccgtgaaggccgattcaccatctccagacgacccttccaaccatacgctgtatctccaaatgaacatggtnacagttgaagacacggcaaacttattatgtgacgaaagtntttacgttggttcgagctatcaatgngagtacgggtgctcgacacgtgggcagggacacgtggcaccgtctcctcacgcctccacacgggcccagtccgtctccccgtggccctaccctcctaccagacgtccacccg

SEQ ID NO: 43632 - DNA, 676 bp, Homo sapiens
  misc_feature: GYAE6OF02F3R3H.31.14.B03.1.454.CMB.1.raw
  modified_base (639)..(639): a, c, t, g, unknown or other
  misc_feature (639)..(639): n is a, c, g, or t
tcagcagtagacgtcacgaccggtgctcgatttagtgtgagtagtttgggcgttggagctgggttttccgtcgttgctccttttaagaggtgtccagtgtctaggtgcacctggtggaatcgtggggaggcgtggtccggcctgggggtccctgagactctccgtgtgccatgtcttgcgtctgaatttcatcctcaggcactatggcagtggtacgtcgggtccggccgacggtcccgacggcgaagggacggtcggaggtggtggcgtagttagtactagtttgtagtaggtacgtaataaaaagtttaacgtccgagtacgtcgtaggaacgggtccgacttacaccgactccgtaccgacgacgtacccgtaccgtaaccgtactaccgactagttaacgtactacctaaagtagaacgtagtcggtagacgaagttgaacgacgaaccgactaacgttattagttcgtacgacgtaaagtaactttcggtttagggtacgtacgactatactaagtaggtggtagtagggtcgtactacgacgtaccgtgggaccgaggaacctacgtcgtaccgtacctccttcctaccgacgtcctacccgaccgaacggccctacgtcgttccccgtcccncgcctacccctcgtcccaaggcctccgtaccgtcggg

SEQ ID NO: 43633 - DNA, 568 bp, Homo sapiens
  misc_feature: GYAE6OF02I0QFP.31.14.B03.1.454.CMB.1.raw
  modified_base (253)..(253): a, c, t, g, unknown or other
  misc_feature (253)..(253): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagacgacccttccaaccatacgctgtatctaccaaatgaacatggtnacagttgaagacacggacaacttattatttgtgacgtaaagtatttcggttaggttcgaagctatcaaagtgtaggagttaggggtgcttacgacacgtcgggcagggacagtgtacaccgtctccgtcacgcctaccaccgaacggccctagtccggtaccttccccgtggaccctaccctacctaccgaacgtacgcctacccgg

SEQ ID NO: 43634 - DNA, 784 bp, Homo sapiens
  misc_feature: GYAE6OF02HIB15.31.14.B03.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggctatgcacgtgggtccnccacggccccaggcaagggctggagtgggtgctatttanacaatttgataggaagtaaattaaaaaagttttcgacaaggtactaccgtaggaaacgggtccgtattaccaacctatacctaccaagaccgtaaccccttaccaaaccattaaccgcgttactaactacctaaccgtaaaagtacgaaacctaagtagggtagtaaccgtaaggtttaacgaaaacggttaaccgaaccgggttaacttaaaaccttttaaagtttagtttacgggttaaggtaaaccgtaaaaaggtttacgttttcgggttttacggggtttaccgaaggttacctaaagttacaaaggttgggtaggttaagtaacgggggtcgtacgttacgaacgtacccgggttgggggaccctaaaggggtaacaccggttcggtacccttaccggtaccttccctacgacgtaccccgtaccgaacccgtaacggggtccctacggttacccggtcccctttcccccgagggccccttaaccccgtcccttaacccgaacggtaccgaccctaacccggg

SEQ ID NO: 43635 - DNA, 579 bp, Homo sapiens
  misc_feature: GYAE6OF02ID08E.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattccatcctcaggcactatggcatgcactgggtccnccaggccccaggcaagggactgggagtgggtgcatttanacaattttgatggagaataaaaattttacgcagactccgtgaagggccgattcaccatctccagacgacccttccaaccatacgctgtatctccaaatgaacatggtnactagttagaaagacatggactaacttattattgtagacgtaaagtatttcggttaggttcgagctatcaattgtgatagggtgctcgacacgtggggaccagggaacacgtggtcaccggtctccgtacacgccctccacccgaacgggccccagtcccggttacccttcccccgtcgggacctacccccttcccttacccgaacgtacgtaccccg

SEQ ID NO: 43636 - DNA, 564 bp, Homo sapiens
  misc_feature: GYAE6OF02IC237.31.14.B03.1.454.CMB.1.raw
  modified_base (357)..(357): a, c, t, g, unknown or other
  misc_feature (357)..(357): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccattctccagagcccttcaaccatacgctgtatctccaatgaacatggtnacagttgaaagcacggctaacttattattgtgtcgaaagtattcgttggttacgagcatcaatgtggataggggtgctcgacaccgtggggaccaggggacacgtggtcaccgttcncctccagtcccncccaccgaacgggcccctagttcccggtcccttcccccgtggccctacccctccctacccaacgaccgcctaccccgg

SEQ ID NO: 43637 - DNA, 1092 bp, Homo sapiens
  misc_feature: GYAE6OF02G76X0.31.14.B03.1.454.CMB.1.raw
tcagcagtagacgtcacgaccggtgctcgatttagtgtgagtagtttgggctgaggctgggtttacctcgttgctactttaagacggtgtccgagttggtcaggtgctacgtggttggaatcgtggggtaggttacggtggtccggctgggggtcctggtagactcgtccgtggtagccaggtggtcttggtccgtactggtaaggttccagtcctctacggtcctacgtagtcggactacttcggtacgtaacgtttacgggttccccgtaccgtacgggtaccccctaagggtaccgaaacgggggtacttggggtaacggttcgggggttcgggtaccgtaacgttttaacggtaaccgtaaacggttttaggggaaacgggttacggggtaaagggtaaacggtttaaaaaaaaacggttttttcccggaaccgtaaacgggtaacccgttaacccgggttaaagggtaaaacgggggggttaccccggggttaaacgtttacccgtaaaccccctaaaccgttaccccgttaaccccggtaaacgggtaaccccggggttaaaccccccgttttaacccccgggaaaacccggggttaacccgtttaacccgggtaacccgttaacgggttaaccttaaccccgttaaaaccggtaaaacggttaaccggtaaaaccctaaacggttacggggtaaacggaacccggttaagggtttacggtaaaacggtaaccgtaaccgggttacctaaaaccgtttaaagtttaacgtttacggtaacggtaacggttaaaacggtacggtttacgggtttaacgggttaccgggtaaacgaccgttaacggtaccgtaaaggtttacggttaggttagggttacggggtacgtaccggtacgtaacccgtaccggtacggggacctaacgggtaactaggttcggttaccgtaccgtttacgtccgttacgaccggtacccgtacctaaccggtaccggtcccctcggttacccggttccccgttaccccgtagggtcccccttaaccccggttcccgtaacccggtaaccgtaccgtaccccgttaccccgg

SEQ ID NO: 43638 - DNA, 546 bp, Homo sapiens
  misc_feature: GYAE6OF02F5TLI.31.14.B03.1.454.CMB.1.raw
  modified_base (254)..(254): a, c, t, g, unknown or other
  misc_feature (254)..(254): n is a, c, g, or t
  modified_base (471)..(471): a, c, t, g, unknown or other
  misc_feature (471)..(471): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagataaaaattttacgcagactccgtgaagggccgattcaccatctccagacgacccttccaaccatacgctgtatctccaaatgaacatggtgacagttgaagacacggcaacttattattgtagacgaaagtatttcgttggttcgagcatcaatgtggatagggtgctcgacaccgtgggccagggacacgtgtcaccgtcncctcacgcctccaccgacgggcccagttccggtccttccccgtggccctaccctcccgtccaacgcgcctacccg

SEQ ID NO: 43639 - DNA, 554 bp, Homo sapiens
  misc_feature: GYAE6OF02H02M8.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttanacaatttgatggagataaaaaattttacgcagactccgtgaagggccgattcaccatctccagacgaccccttccaaccatacgcttgtatctaccaaatgaacatggtgacagttagaagacacggcaaacttattattgtagacgaaagatttacgttggttcgagcatcaatgtggatagggtgctcgacaccgtgggccagggaacacgtggtcaccgtcncctcacgcctccaccgagggcccaatccggtccttccccctggcccacccgtccctaccgaacgacgcctacccg

SEQ ID NO: 43640 - DNA, 609 bp, Homo sapiens
  misc_feature: GYAE6OF02G3O3Q.31.14.B03.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtggggtggctatttanactaatttgatggaagaattaaaaaattttcgacagtactccgtgaagggccgattcaccatctccagacgacccttaccaaccatacgctcgtatctaccaaatgaactatggtanactaggttagaagacacggtactaactttattaattgtagacgaaagtattcggtttaggtcgagactatacaatggtggagtagggtgcgtacgacaccggtcggggaccgaaggaacgtacgtgggtaccctaccgttcctccgtacacgtaccctacccaaccgacggcccctacgtccggtccccttccccgtcggaccctacccgtccctaccgaacgcgtcctacccgg

SEQ ID NO: 43641 - DNA, 591 bp, Homo sapiens
  misc_feature: GYAE6OF02HVUY9.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatggcactggggtccnccaggccccaggcaagggctgggagtgggtgctagtttanactaatttgattggagaataaaaattttacgcagactccgtgaaggccgattcacatctcagcaccttcaaccatacgctgtactctaccaaatcgaactatggtagacagttagaaagacaacggactaacgttattattgtagacgtaaagtntttacgttggttacgagctatacaagtgtagagtagggtgcctacgacaccgtggggccaagggactagtcggtactaccgtcctcctcgacgccctccgaccgtaacgggccctaacgttccggtcccttcccccgtcggaccctaccccgtcccttaccgaacggtccgccctaacccgg

SEQ ID NO: 43642 - DNA, 549 bp, Homo sapiens
  misc_feature: GYAE6OF02FVHM8.31.14.B03.1.454.CMB.1.raw
  modified_base (253)..(253): a, c, t, g, unknown or other
  misc_feature (253)..(253): n is a, c, g, or t
  modified_base (398)..(398): a, c, t, g, unknown or other
  misc_feature (398)..(398): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaatttacgcagactccgtgaagggccgattcaccatctccagagacccttccaaccatacgctgtatctaccaaatgaacatggtgacagttgaagacacggcaaacttattattgtgacgaaagntttcgttggttcgagcatcaatgtggatagggtgctcgacaccgtggggccagggacacgtggtcaccgtctcctcacgccctccaccgaagggccccaagtccggtccttcccccgtggcccaccccttccctaccaacgcgcctacccg

SEQ ID NO: 43643 - DNA, 583 bp, Homo sapiens
  misc_feature: GYAE6OF02IDRM5.31.14.B03.1.454.CMB.1.raw
  modified_base (256)..(256): a, c, t, g, unknown or other
  misc_feature (256)..(256): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
  modified_base (574)..(574): a, c, t, g, unknown or other
  misc_feature (574)..(574): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggactgggagtgggtggctatttanactaatttgatggagaattaaaaaattttacgcagactccgtaggaagggccgattcaccatcctcagacgacccttaccaaccatacgctagtactctaccaaatgaacatggtnacgtagttagaaagacaacggactaacttattattgtagacgtaaagtattcggtttggtacganacatacaagtgtggagtaggtgctcgacaccgtgggaccagggaacacgtggtccgaccgtcctctccacgccctaccgaccgaccggcccaacgtccggtcccttccccgcgccctacccctcctaccgaacgccncctacccgg

SEQ ID NO: 43644 - DNA, 682 bp, Homo sapiens
  misc_feature: GYAE6OF02GLURI.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggctgggagtgggtggctatttatacaatttgagtggaagtaattaaaaaagttttacgacaagtactccggtaggaacggggccgtattaccaccattcctccgaagacgtaccccttaccaaccatacgcttgtaactcctaccaaatacgaaactagtaggtacgactagttagaacgacgacggtactaaactttattagttgtacgacggtaaagtgtttacggttggttcgagtcattacaagtggtaggacgtggggttcgccgtacgactccgggtcggggaccgtaaggggactacgtcggtaccgtacccgtacctcccgtacgaccgtcccctacccgaaccggaaccgggtcccctacggttcccgggttcccttaccccccgtaggtacccctaccccgttaccccgttacccaaacggtccggtaccctaccccggg

SEQ ID NO: 43645 - DNA, 564 bp, Homo sapiens
  misc_feature: GYAE6OF02FVKMI.31.14.B03.1.454.CMB.1.raw
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccgacctgggggtccctgagactctcctgtgccatgtctgcgtctgaattcatcctcaggcactatggcatgcactgggtccgccaggccccaggcaagggactggagtgggtggcatttatacaatttgatggagtaataaaaattttcgcagactccgtgaagggccgattcaccatctccagacgacccttccaaccatacgctgtatctaccaaatgaacntggtnactagttgaagacacggactaaactttatttactgtgacgtaaagatttcgttggttcgagcatcaatgtaggatagggtgctcgacaccgtggggccagggacacgtggtccacgttctcctcagtccctacgaccaacgggcccaagtccggtcctttccccgnggaccctaccccttccacccgaacgacggtcctacccg

SEQ ID NO: 43646 - DNA, 553 bp, Homo sapiens
  misc_feature: GYAE6OF02FSF7R.31.14.B03.1.454.CMB.1.raw
  modified_base (251)..(251): a, c, t, g, unknown or other
  misc_feature (251)..(251): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttanacatttgatggagataaaaatttacgcagactcgtgaaggccgattcacatctccagacgacccttccaaccatacgctgtatctcaaatgaacatggtgacagttanaagacacggctaacttattagttgtgtacgaaagtntttcgttggtttacgagtcagtcaatgtaggaattagggtgccgtgacctaccggtgggccagggaactcgtcggtcaccgtctcctcgacgccctaccaccgaggcccactccggttcctcccccgtgaccctccctcctaccacgtacgctacccg

SEQ ID NO: 43647 - DNA, 597 bp, Homo sapiens
  misc_feature: GYAE6OF02I29W7.31.14.B03.1.454.CMB.1.raw
  modified_base (248)..(248): a, c, t, g, unknown or other
  misc_feature (248)..(248): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcaagggactgggagtggggngcatttatacaatttgatggagaataaaaaattttacgcagactccgtagaagggccattcaccatctccagacgaccccttaccaaccataccgcttgtatcctaccaaatgaacatggtnactagttagaagacacggactaaacttattatttgtagacgtaaaagtatttcggtttggtttacgagtactatactaatggtggagtaggggtgtctcggaacgacgtcgggaccagggaacacgtcggtcacccgtcctcctcacgcctaccaccgaaccggccctacgtccggtcccttccccgtcggtccctaccccgtccctacccaacgccgcctacccgg

SEQ ID NO: 43648 - DNA, 559 bp, Homo sapiens
  misc_feature: GYAE6OF02F2UML.31.14.B03.1.454.CMB.1.raw
  modified_base (255)..(255): a, c, t, g, unknown or other
  misc_feature (255)..(255): n is a, c, g, or t
  modified_base (366)..(366): a, c, t, g, unknown or other
  misc_feature (366)..(366): n is a, c, g, or t
  modified_base (458)..(458): a, c, t, g, unknown or other
  misc_feature (458)..(458): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (551)..(551): a, c, t, g, unknown or other
  misc_feature (551)..(551): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggcaagggactgggagtgggtggcatttanacaatttgatggagaattaaaaaattttacgcagactccgtgaagggccgattcaccatctccagacgaccccttccaaccatacgctgtatctccaaatgaaacatggtnacagttagaagacacggcaactttattatttgtgacgaaagtatttcggttggttcgagactataccgaatgtaggatacgggtgctcgacnccgtggggccaagggacacgtgtcacgtctcctcacgccctccaccgacggcccagtccggtccttccccgnggcccnccctcctccaacgcncctacccg

SEQ ID NO: 43649 - DNA, 630 bp, Homo sapiens
  misc_feature: GYAE6OF02F1T0S.31.14.B03.1.454.CMB.1.raw
  modified_base (255)..(255): a, c, t, g, unknown or other
  misc_feature (255)..(255): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaaggggactgggagtgggtgcatttanacaatttgatggagaattaaaaaattttacgacagactccgtgaagggccgattcaccatctccagacgacccttccaaccatacgctgtatctaccaaatgaacatggtgacagttgaagacacggactaacttattatgtagacgtaaagtntttcggttggttacgagctaatcaaattggtaggtaagttaggggtcggcgttacgaccgtaccgtcgggggacccaaggggaacctacggttcgggtaccacccgttcctccctacgacgtcccctaccgaacccgtaacgggcccctaagttcccggttaccctttccccccgtggacccctaccccgttccctacccgaacggtaccgcctaccccgg

SEQ ID NO: 43650 - DNA, 602 bp, Homo sapiens
  misc_feature: GYAE6OF02I6D4P.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtgcatttanacaatttgatggagataaaaaattttacgcagactccgtgaaggccgattcaccatctccagagacccttccaaccatacgctgtatctaccaaatgaacatggtgacagttgaagacacggacaacttattattgtgacgaaagtattcgttggttcgagcatcaatgtggtaataggtagtgtcgtacgaccgtacgggtcggaccgaaggaactacggtcgtaccgtaccgtcctcaccgtacctccctacccgaaccggtaccgggacccttacggttaccccgttcccttacccccggtacggaccccttaccccgtccctaaccggaacgtaccgtaaccccg

SEQ ID NO: 43651 - DNA, 538 bp, Homo sapiens
  misc_feature: GYAE6OF02IHP2B.31.14.B03.1.454.CMB.1.raw
  modified_base (510)..(510): a, c, t, g, unknown or other
  misc_feature (510)..(510): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactgggagtgggtggcatttatacaatttgatggagaataaaaaattttacgcagactccgtgaagggccgattcaccatctcagagacccttccaaccatacgctgtatctccaaatcgaacatggtgacagttgaagacaacgcaaactttattattgtagacgaaagtatttcgttggttcgagcatcaatgtaggatagggtgctcgacaccgtggggccagggacacgtggtcaccgtctctcagcctccaccaggcccatcggtccttccccnggcccacccgtccaccaagccnctaccg

SEQ ID NO: 43652 - DNA, 570 bp, Homo sapiens
  misc_feature: GYAE6OF02F4LP1.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaatttacgcagactcgtgaggccgattcacatctccagacgacccttccaaccatacgctgtatctaccaaatgaacatggtgacagttgaagacacggctaaactttattattgtgacgtaaagatttcggtttggttcgagactatacaagtgtaggataggggtgctcgacaccgtggggaccagggaacacgtggtccaccgtctcctcacgccctaccaccgaacgggcccctaacgttccggtcccttcccccgtggccctacccctccctacccgaagtccgacctacccgg

SEQ ID NO: 43653 - DNA, 657 bp, Homo sapiens
  misc_feature: GYAE6OF02HQD2T.31.14.B03.1.454.CMB.1.raw
  modified_base (646)..(646): a, c, t, g, unknown or other
  misc_feature (646)..(646): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcacgtgggtccgccaggccccaggcaagggactgggagtgggtgctatttatacaatttgattggagaataaaaattttacgcagactccggtgaagggccgattcaccactctaccagagacccttaccaacctactacgactgtactctaccaaatacgaactataggtagactacgttagaagaacgaccggacgtaacttactttaatttgttagtacgaaaggatttacggtttggttacgtagactagtactaagtgtggaagttagggtacggccgttcgaacgacccgttggggtaccggaacgggaaccgacgtacggtccgtaacccggttccttacccgtctacgtacccaccctaacccggaacgggacccccacggttacccggtcccgtttcccccgtcggccctaccccgtccctacccgtaacggacnccgtaccccgg

SEQ ID NO: 43654 - DNA, 710 bp, Homo sapiens
  misc_feature: GYAE6OF02H80JN.31.14.B03.1.454.CMB.1.raw
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggccnccaggccccaggcaagggctggagtgggtgctattatacaatttgatggagaataaaaattttacgnagactccgtagaaggccgattcacatctccagacgtacccctcaacctataccgctntaatcctacaaatgaaacatggtgacagttgaaagaccacggctaacttatatttganacgaaagtnttacgttggttacgagcaagttacaaagttggtaggtaaagttaggggtggaccgttacgtaaccgaccggttacgggggacccgaaaggggtaaccctaacggttcgggtacctaacccggttcccttacccgtaccgttaacgggaccccttaccccgtaaacccgggaaccgggggtcccccctaaaccggtttccccggggttaacccccttttaccccccccggtcggggttaccccgtaccccccgtttacccccttaacccccggaaagggttacccggaccccgttaaccccccggg

SEQ ID NO: 43655 - DNA, 610 bp, Homo sapiens
  misc_feature: GYAE6OF02GIKEO.31.14.B03.1.454.CMB.1.raw
  modified_base (253)..(253): a, c, t, g, unknown or other
  misc_feature (253)..(253): n is a, c, g, or t
  modified_base (565)..(565): a, c, t, g, unknown or other
  misc_feature (565)..(565): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaatttacgcagactccgtgaaggccgattcaccatctccagacgaccccttaccaaccatacgctagtatcctaccaaatagaacatggtagaacagttagaagacacggactaacttattattgtagacgtaaagtatttcgttaggttcgagtcatacaagtggtaggagtaggggtcgtctacggaccaccggtggggaccgaagggaacctacgtcggtaccacccgttctcctcgacgtccctacccaccgaaccgggccctacggttcccggtccctttcccccgnggtacccctaccccgtcccgtaccgaacggtaccgccctacccgg

SEQ ID NO: 43656 - DNA, 602 bp, Homo sapiens
  misc_feature: GYAE6OF02HAVAK.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (448)..(448): a, c, t, g, unknown or other
  misc_feature (448)..(448): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagataaaaaattttacgcagactccgtgaaggccgattcaccatctccagacgacccttccaaccatacgctgtatcaccaaatgaacatggtagactagttgaagacacggacaacttattatgtagacgtaaagtattcggtttggtacgagtcaatcaaagtgtaggagttagggtcgtcncgacaccgtggggaccagggaaccacgtaggtccaaccgttcgtcctacgacgccctaccaaccgtaacgggcccctaacgttcccggttaccctttccccccgtacgggtccctacccccgtcccttacccgaacgtaccgaccctaccccgg

SEQ ID NO: 43657 - DNA, 661 bp, Homo sapiens
  misc_feature: GYAE6OF02HI19W.31.14.B03.1.454.CMB.1.raw
  modified_base (255)..(255): a, c, t, g, unknown or other
  misc_feature (255)..(255): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactggagtgggtgctatttanacatttgatggagaataaaaattttacgacagactccgtagaagggccgattcaccatctccagacgacccttccaaccatacgctgtatctacaaatcgaacatggtanacagttagaagacacggacaacttattatgtgacgtaaagtagtttcgttggtcgagctatacaagttgtaggagtaggggttcggcgtaccgaaccgtaccggtcgggggacccgtaaacggggaacctaccggttacggtaccgtaccccgttaccgtacccgtaccgaacgtcccccttaccgaacccgtaaccggggtccccctaacgttccccgggttaccccctttccccccgtgggtacccccaaccccgttaccctaaccccgaacggtaccgtaccctaaccccggg

SEQ ID NO: 43658 - DNA, 557 bp, Homo sapiens
  misc_feature: GYAE6OF02HZN71.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagagaccccttccaaccatacgctgtatctccaaatgaacatggtgacagttgaagacacggacaactttattatttgtgacgaaagattcgttggttcgagcaatcaatgtggatagggtggctcgacacctggggccagggaacacgtggtaccaccgtctcctcagccctccaaccaacgggcccacgttccggtccttccccccgtggcccacccgttcctcccaagacgctacccgg

SEQ ID NO: 43659 - DNA, 638 bp, Homo sapiens
  misc_feature: GYAE6OF02HOBN0.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaatttacgcagactccgtgaaggccgattcaccatctccagacgacccttccaaccatacgctgtactctaccaaatcgaacatggtanactagttgaagacacggacaaactttattagttgtagacgtaaagtatttcgttgggtttacgagactaatactaaagttggtaggtaagttaggggtggtcctacggacctaccgtcgggggacccaaggggtaacctacgtcgggtacctaccgttcctaccgtaccacgtcccctaccgaacccgtaacggggacccctagttcccgggttcccttaccccccgtggacccctaccccgttaccctacccgaaacggtccgaccctaaccccgg

SEQ ID NO: 43660 - DNA, 708 bp, Homo sapiens
  misc_feature: GYAE6OF02HV4CN.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctcaggcactatggcatgcacgtgggtccgccaggccccaggcaagggactgggagtgggtgctatttanacaatttgatggagtaataaaaatttacgcagactccgtgaagggccgattcaccatctcagacacccttccaaccatacgctgtatctaccaaatgaactagtggtagactagttagaaagacgacggactaaactttattattagtagacgtaaagtcgtttacggtttggttacgagtccgaatacgaattggtaggtaacggttaggggtacggccttacggaaccgacccgggttagggggacccgaaagggggaaacctaccggttacgggtacccgtacccgttccctacccgtaccgtaccgtccccgtaaccccgaaccggtaacccggggcccccttaacggttccccgggttacccccttttaccccccggcggtaccccctaccccccggttaccccgtaaccccggaaaccggtacccggtacccgttaaccccccggg

SEQ ID NO: 43661 - DNA, 548 bp, Homo sapiens
  misc_feature: GYAE6OF02I6RBI.31.14.B03.1.454.CMB.1.raw
  modified_base (250)..(250): a, c, t, g, unknown or other
  misc_feature (250)..(250): n is a, c, g, or t
  modified_base (355)..(355): a, c, t, g, unknown or other
  misc_feature (355)..(355): n is a, c, g, or t
  modified_base (467)..(467): a, c, t, g, unknown or other
  misc_feature (467)..(467): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggcatgcactgggtccgccaggccccaggcaagggactggagtgggtgcatttanacaatttgatggagataaaaattttacgcagactccgtgaaggccgattcaccatctccagacgaccttccaaccatacgctgtatctaccaaatgaacatggtnacagttgaagacacggcaacttattattgtagacgaaagattcgttggttcgagcatcaatgtggataggtgctcgacacgtgggccagggacacgtggtcaccgtctcctnacgcctaccaccgaacgggccctacgtccggtccttcccccgtgggaccctacccctccctacccaagtacgcctacccgg

SEQ ID NO: 43662 - DNA, 695 bp, Homo sapiens
  misc_feature: GYAE6OF02G8SGW.31.14.B03.1.454.CMB.1.raw
  modified_base (221)..(221): a, c, t, g, unknown or other
  misc_feature (221)..(221): n is a, c, g, or t
  modified_base (626)..(626): a, c, t, g, unknown or other
  misc_feature (626)..(626): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatcgtggggaggcgtggtccggccgtgggggtccctgagacctctcctgtcgccatgtctgcgtctgaattcatccgtcaggcactatggcatgcacgtcgggtcccnccacggccccaggccgaagggctgggaggtggggtcgctatttatactaatttggatggaagtaattaaaaaacgtttcgacgtaacgaccgtaccggtaggaacggggaccgtagttccgaaccgtattcccgtaccgaacggaccgtaaccccgttacccaaacccaacttaccgtaccgttacgtactaccgtaaccgaaagttacgaaacctaagttacggtagaaccgtaggttaacgaacgtaacgaccggaactaaactttagttacgtttcgtagtacgtaaagtcgttttcggttacgggttacgacgtcgtacgtactaagtcggttagggtagttagggtacgtcgtacgaccgtacggtcgggaccgaaggactacgtcggtcgaccgttccncgacgctcccgcgaccgacggtcccagttccgtcccttcccgcgcctacccgtccacacgctcctaccg

SEQ ID NO: 43663 - DNA, 659 bp, Homo sapiens
  misc_feature: GYAE6OF02HHTTJ.31.14.B03.1.454.CMB.1.raw
  modified_base (215)..(215): a, c, t, g, unknown or other
  misc_feature (215)..(215): n is a, c, g, or t
  modified_base (369)..(369): a, c, t, g, unknown or other
  misc_feature (369)..(369): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccaggccccaggcaagggactgggagtggggtggctatttatactaatttgatggagaataaaaaattttacgcagactccgtgaagggccattcaccatctccagacgacccttaccaaccatacgctgtatctaccaaatacgaacatggtnacagttgaagacgaacgacaaacttattatttgtagacgtaaaagtatttcggttaggttcgagcaatctaaatggtaggtaagtaggggttgccgttacggacctaccggtacgggggacccgaaggggtaaccacgttggtacccgacccggttcctacctccgacgtcccttacccgaaccggaaaccgggcccctaacgttcccgggttacccctttccccccggtaccggtcccctaacccccgttccccttacccgaaacggtaccggacccgttaacccccgg

SEQ ID NO: 43664 - DNA, 650 bp, Homo sapiens
  misc_feature: GYAE6OF02JW7CL.31.14.B03.1.454.CMB.1.raw
  modified_base (263)..(263): a, c, t, g, unknown or other
  misc_feature (263)..(263): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (544)..(544): a, c, t, g, unknown or other
  misc_feature (544)..(544): n is a, c, g, or t
  modified_base (552)..(552): a, c, t, g, unknown or other
  misc_feature (552)..(552): n is a, c, g, or t
  modified_base (608)..(608): a, c, t, g, unknown or other
  misc_feature (608)..(608): n is a, c, g, or t
tcagcagtagacgtcacgaccggtgctcgatttagtgtgagtagtttgggctgagctgggttttccttcgttgctcttttaagaggttgtccagtgtcaggtgcacctggtggaatctgggggaggcgtggtccggcctggggggtccctgagactctcctgtgccatgtctgcgtctgaatttcatcctcaggcactatggcatgcacgtgggtccgccaggccccaggccaaggggctgggaggtgggtggactattttanactaagttttgattggaagtaattaaaaaacttttcgcagtactccgtgaacgggccattcaccatctccagacgtacccttcaaccatacgctgtacnctacaaatgaacagtggtnacagttagaacgacaacggactaaactttattagtttcggtagacggtaaaagtgttttacggtttcgggtacgagctaattaccgaaagttgggtaggaagttggggttagccgttacgacaccgggtgggaccaaggggactacggtgtacccgacccgtnttcccganaccggcccttaccgaaccgtaccgggccccgtattcccggtccctttacccccggnggaccctccccgtacctccggaaacgtccgacccgtaaccgg

SEQ ID NO: 43665 - DNA, 675 bp, Homo sapiens
  misc_feature: GYAE6OF02JTZZL.31.14.B03.1.454.CMB.1.raw
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagcagtagacgtcacgaccggtgctcgatttagtgtgagtagtttgggctgagcgtggtttcgcgtagctctttaagaggtgtccagtgtcaggtgcacctggtggaatctgggggagcgtggtccggcctggggggtccctgagactctcctgtgccatgtctgcgtctgaattcatcctgaggctactatggcatgcacgtgggcccncacggccccaggcaagggctggagtgggtgacatttatacaatttggatggaataattaaaaatttcgcaggctcgagaggcctatcacntcacagactcctacaaccgntcnctagtactcctacaananactagtggacacgtagtacgaacgacgacgtacttaattntagttagcgtaacgtaagttcgtttggttacggtacgacgtntagtacgtaagttggtaggtacggttagggtacgtccgttacggaaccggtaccgggtcggggtaaccgtaacgggtaaccgtacgggttccgtacccgtacccgttaccgtacccgtaccgtacccgtaccctaccggaacccggtaacccggtcccgttaaccgttccccgggtttaacccccgtccccggtaccggtaccccttaccccgacccgttaacccgaacggtccccgtaccccgtacggg

SEQ ID NO: 43666 - DNA, 652 bp, Homo sapiens
  misc_feature: GYAE6OF02IKYHB.31.14.B03.1.454.CMB.1.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctcaggcactatggcatgcacgtgggtcccaccaggccccaggccaagggctgggagtgggngcatttanactaatttgatagganaaataaaaaagttttacgacagactccgtagaagggccgtatcatcatctaccagacgacccttaccaacactacgctagtactctaccaaatgaactagtgtagactagttagaagacacggactaacttattatgtagacgtaaaagtnttacggttgttacgagtactatacaagtgtaggagttaggggtgtaccgtcgaaccgtaccgtcggggaccgtaaggaaccgtacgtcgggtacctaacccggtctacccgtacaccgtaccctaccgaacccgaaagggtccctacggtaacctttccccggttccccgtttaccccccgtcggtaccccgtaaccccccgttaccctaccccggaagtaaccccggg

SEQ ID NO: 43667 - DNA, 564 bp, Homo sapiens
  misc_feature: GYAE6OF02HBC38.31.14.B03.1.454.CMB.1.raw
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (474)..(474): a, c, t, g, unknown or other
  misc_feature (474)..(474): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcagggcactatggcatgcactgggtccgccaggccccaggcaagggactggagtgggtggcatttatacaatttgatggagaataaaaattttacgcagactccgtgaagggccattcaccatctccagacgacccttccaaccatacgctgtatctaccaaatgaacatggtnacagttgaagacacggactaaacttattatttgtagacgaaagtntttcgttggttcgagcatcaatggtaggagttaggggtgcctcgacaccgtggggacccaagggaacncgtggtccaccgtctacctcacgccctccacgacgggcccagtccggtcctccccgtggccctaccctcctaccgaagaccgcctacccg

SEQ ID NO: 43668 - DNA, 565 bp, Homo sapiens
  misc_feature: GYAE6OF02HGH63.31.14.B03.1.454.CMB.1.raw
  modified_base (214)..(214): a, c, t, g, unknown or other
  misc_feature (214)..(214): n is a, c, g, or t
  modified_base (365)..(365): a, c, t, g, unknown or other
  misc_feature (365)..(365): n is a, c, g, or t
  modified_base (457)..(457): a, c, t, g, unknown or other
  misc_feature (457)..(457): n is a, c, g, or t
  modified_base (535)..(535): a, c, t, g, unknown or other
  misc_feature (535)..(535): n is a, c, g, or t
  modified_base (556)..(556): a, c, t, g, unknown or other
  misc_feature (556)..(556): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtggcatttatacaatttgatggagaataaaaaattttacgcagactccgtgaagggccgattcaccatctccagacgaccccttccaaccatacgctgtatctaccaaatgaaacatggtnactagttagaagacacggactaaacttattaatttgtgacgaaagtatttcggttggttcgagcatcaagtgtaggataggggtgctcgacnccgtgggaccaggacacgtggtaccaccgttctcctcacgccctccaaccgacggcccagttccggtcccttccccgngcccaccctcctaccgaagcncctacccgg

SEQ ID NO: 43669 - DNA, 548 bp, Homo sapiens
  misc_feature: GYAE6OF02GWDHD.31.14.B03.1.454.CMB.1.raw
  modified_base (214)..(214): a, c, t, g, unknown or other
  misc_feature (214)..(214): n is a, c, g, or t
  modified_base (484)..(484): a, c, t, g, unknown or other
  misc_feature (484)..(484): n is a, c, g, or t
  modified_base (521)..(521): a, c, t, g, unknown or other
  misc_feature (521)..(521): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagataaaaatttacgcagactccgtgaagggccattcaccatctccagacgaccccttccaaccatacgctgtactctaccaaatgaacatggtgacagttagaagacacggactaactttattattgtgacgaaagtatttcgttggttcgagcatcaagtgtggagtagggtgctcgacaccgtgggccaagggacacgtggtccaccgtctcctcncgcctaccaccgacggcccagtccggtccttccccgngcccaccctcctaccacgcnctacccg

SEQ ID NO: 43670 - DNA, 591 bp, Homo sapiens
  misc_feature: GYAE6OF02GO42H.31.14.B03.1.454.CMB.1.raw
  modified_base (564)..(564): a, c, t, g, unknown or other
  misc_feature (564)..(564): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactggggtccgccaggccccaggcaagggactgggagtgggtggctattttatacaatttgatggaagtaataaaaaattttacgacagtactccggtagaacggggccgattccacctatctaccagacgaccccttaccaaccataccgctgtatcctacaaatgaacagtggtagactagttagaacgacacggactaacttattattgtgacgaaagtatttcgttaggttcgagtcatacaagtggtggtagtagggtggctcgacaccggtgggaccagggacacgtggtccaccgtctcctcacgcctaccaccgaacgggccctagtcccggtcccttcccccgtcggcccnccctccctaccaacgccgacctacccg

SEQ ID NO: 43671 - DNA, 546 bp, Homo sapiens
  misc_feature: GYAE6OF02FH7AY.31.14.B03.1.454.CMB.1.raw
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttanacaatttgatggagaataaaaaattttcgcagactccgtgaagggccgattcaccatctccagacgaccccttccaaaccatacgctgtatctccaaatgaacatggtnacagttagaaagacacggactaaactttattaattgtgacgaaagatttcgttggttcgagcatcaatgtggatagggtgctcgacaccgtggggccagggacacgtggtcaccgtctcctcacgcctcaccgaagggcccatcggtacttcccccgnggccaccctcctaccaagacnctacccg

SEQ ID NO: 43672 - DNA, 731 bp, Homo sapiens
  misc_feature: GYAE6OF02FLFSC.31.14.B03.1.454.CMB.1.raw
  modified_base (298)..(298): a, c, t, g, unknown or other
  misc_feature (298)..(298): n is a, c, g, or t
  modified_base (384)..(384): a, c, t, g, unknown or other
  misc_feature (384)..(384): n is a, c, g, or t
tcagcagtagacgtcacgaccggtgctcgatttagtgtgagtagtttggctgaggctgggtttcctacgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggccccaggcaagggactgggaggtgggtcggctattttataactaatttgataggaataattaaaaaagttttcganaacgactccgtaggaaggccgattcaccactctaccagactaccccttaccaacctataccgcttgtactcctaccaaatgaaacngttggagacagttagaagacacggtactaactttattagttgtagacgaaaagtgttccgttaggtttccgagtactatacgtaatggttaggtaagtacggggttcgccgttaccgacgaccgggttacgggggacccgaaagggggtaacccacggtttccgggtaccgttacccggttccttacccgttacctaaccgggtccccttaccccggaacccggaaacccggggtccccttaaccggtttccccgggttaccccccttttcccccccgggtagggttaccccccaaccccgtttccccgtaacccgtaaacggggcccctaccccgttaaccccggg

SEQ ID NO: 43673 - DNA, 576 bp, Homo sapiens
  misc_feature: GYAE6OF02I3ZG6.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagagaccccttccaaccatacgctgtatctccaaatgaacatggtgacagttgaagacacggcaacttattattgtgcgaaaagtacttcggttggttcgagtcatcaatgtggatagggtgctcgacaccgtggggccagggaacacgtggtcaccgttctccctcgacgccctaccaccgaacgggtccccagttcccgggttccttccccccgtgggaccctaccccttccctacccgaacgtaccggcctaaccccgg

SEQ ID NO: 43674 - DNA, 562 bp, Homo sapiens
  misc_feature: GYAE6OF02IHZQ5.31.14.B03.1.454.CMB.1.raw
  modified_base (252)..(252): a, c, t, g, unknown or other
  misc_feature (252)..(252): n is a, c, g, or t
  modified_base (473)..(473): a, c, t, g, unknown or other
  misc_feature (473)..(473): n is a, c, g, or t
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggctgagcgtggtttctcgttagctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagaataaaaattttacgcagactccgtgaagggccgattcaccatctccagagacccttccaaccatacgctgtatctccaaatgaacatcggtagacagttagaagacaacggctaaactttattattgtgacgaaagtatttcgttaggttacgagtactatcaatggtaggataggggtggctcgacacgtggggaccagggaacncgtggcctaccgtctcctcagcctccacgaacggccctagtccggtccttcccccgngtcccaccctcctacccaagtcncctacccgg

SEQ ID NO: 43675 - DNA, 603 bp, Homo sapiens
  misc_feature: GYAE6OF02H3XAI.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (445)..(445): a, c, t, g, unknown or other
  misc_feature (445)..(445): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaaaggggactggagtgggtggcatttanacaatttgatggagaataaaaattttacgcagactccgtgaagggcgatcacatctcagagaccttcaaccatacgctgtatctaccaaatgaacatggtagactagttagaagtacacggacaaacttattaatgtagacgaaagtatttacggtttggtcgtaggacatacaatggtgaagttagggngactcgacaccgtggggaccaagggtaacacgtggtaccaacgttccnccttacgacgtccctacccaaccgaagggccccctaattccgggtaccctttcccccccgtggccctaacccccgttcccttacccggaaacgacggccttaacccccgg

SEQ ID NO: 43676 - DNA, 682 bp, Homo sapiens
  misc_feature: GYAE6OF02H9PS1.31.14.B03.1.454.CMB.1.raw
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (368)..(368): a, c, t, g, unknown or other
  misc_feature (368)..(368): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtntgaattcatcctcaggcactatggcatgcacgtgggtccncacggcccaggcaagggctggaggtgggtgactatttatactaatttgatggaagtaataaaaatttcgacagactcgtgaaggccgatcaccatctacagacgaccctacaacctatacgctagtatcctacaaatagaactactggtanaactaggttagaaaagaccaacggtactaaactttaattagtttcgagaacgaaagtacttcggttttagggttacgaaggtactaatacgtaaatagggttaggaaaggtacggggttcggccttaccggaactacccggttagggggacccgaaaggggaacctaacgttggggtacccaaccggttacctccgttaccgagtccccctaccgaacccgaacgggcccctaacgttcccggttaccccgtttcccccgacgggtaccctaacccccgtcccgttaaaccgaaacggacccgacctaacccgg

SEQ ID NO: 43677 - DNA, 745 bp, Homo sapiens
  misc_feature: GYAE6OF02HQEO9.31.14.B03.1.454.CMB.1.raw
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (430)..(430): a, c, t, g, unknown or other
  misc_feature (430)..(430): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcggtgggtccgggccgtggggggtccctggagactctcctgtgccatgtctgcgtctgaattcatcctcaggcactatggcatgcacgtggggtcccnccacggccccagggacgaaggggactggggaggtggggtggctatttanaactaatttgatggaagtaaattaaaaaattttacgactaagtactccggtaggaacgggccgtaacttacaacctactcctaccaacgaaccgtaccccttaccaaaccataccgcttagtactacctaacctaaagtacgaaactaagtgggtanaacgtaaggttagaaagacgaacggactaaactttatatttggtagaacgtaaagtacgtttacggtttaggttacgacggtactaacgtactaaggttggtagggtaaggttacggggtcgtccgtacgacccgtaccgggtacggggaccgaacgggtaaccgtacgttacggtacccgacccgttccttaccaccgaccgtcccctacccgaacccggtaacgggcccctacggttacccgttccccgttaccccccggtacggtacccctacccccgttcccgacccgtaaacgacccggtacctacccgg

SEQ ID NO: 43678 - DNA, 617 bp, Homo sapiens
  misc_feature: GYAE6OF02FF3OR.31.14.B03.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctggggagcgtggtccggcctgggggtccctgagactctcctgtgccatgtctgcgtctgaattcatcctcaggcactatggcatgcacgtgggtccnccagggccccaggcaagggactggagtgggtgctatttanacaatttgatggagtaattaaaaatttcgcagactccggtagaagggccattccaccatctcanacgacccttcaaccntacgctgtactctaccgaaaatgaaacctgtggtacgaacctaggttacgaaacgaccaacgggactaaacctttagttaagttgagacgtaaagtnttttccggttggttacgagtcaattacaatggttaggagtaggggttcgctcgaccaccgttggggaccagggtaacacgtaggttccacccgtctcctcgacgtccctacaccgaacgggtccccagtcccggttccctttcccccgtaggtccccaccccgttccacccgaagtaccgccctacccgg

SEQ ID NO: 43679 - DNA, 700 bp, Homo sapiens
  misc_feature: GYAE6OF02GXG1W.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactgggagtgggtgcagtttanacaatttgatggagaattaaaaattttacgacagactccgtggaacgggccgattcacatctaccagacaccttccaaccatacgctgtactctaccaaatgaacatggtacgacgtagttagaagaacgacggactaaacttattagttacggtagacgtaaaggtactttcgggtttggtacgagtcgtaacgttacgtaaagttggtacgggtaagttacgggggttgaccgttccggaaccgtaccgggtacgggggacccgaaacggggtaacctacggttaccgggttacccgaacccgtttcctcccgtaccgaccggtcccttacccgaaccgtaacccggggtaccccttaaccgttcccgggttaccccgttcccccggtaggtaccccctaccccgttcccgtaacccggaacggtacccgtaccctaccccggg

SEQ ID NO: 43680 - DNA, 573 bp, Homo sapiens
  misc_feature: GYAE6OF02FQRSL.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacatttgatggagaataaaaatttacgcagactccgtgaagggccgattcaccatctccagagaccccttccaaccatacgctgtatctaccaaatgaacatggtagacagttagaagacacggactaacttattattgtagacgaaagtatttcgttggttcgagtcatcaatgtaggtagtagggtgctcgacaccgtggggccagggacacgtggtacaccgtctcctacacgccctccaccgaacgggccctacgttccggtcccctttcccccgtggaccctaccccgtccctaccgaacgaccgaccctacccgg

SEQ ID NO: 43681 - DNA, 597 bp, Homo sapiens
  misc_feature: GYAE6OF02H4XQI.31.14.B03.1.454.CMB.1.raw
  modified_base (214)..(214): a, c, t, g, unknown or other
  misc_feature (214)..(214): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggccaagggactgggagtggggtgcagtttatacaatttgatggagaataaaaaattttacgcagactccgtgaagggccgatcaccatctccagagacccttccaaccatacgctgtatctaccaaatgaacatggtnacagttgaanacacggcaacttatactttgtgacgaaagtntttacggttggtcgagtcatacaatgtggagtagggtggtctcggacaccgtggggccaaggggaaccacgtcggtacaccgttctccctacgacgtcccttacccgaacccgtaacgggcccctacgtcccggttccctttcccccgtcggaccctcccccgttacctcccgaacgtacgccctaacccggg

SEQ ID NO: 43682 - DNA, 628 bp, Homo sapiens
  misc_feature: GYAE6OF02HXQTW.31.14.B03.1.454.CMB.1.raw
  modified_base (217)..(217): a, c, t, g, unknown or other
  misc_feature (217)..(217): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtcccnccgacggccccaggcgaaagggactgggaggtggggtggctattttaatactaatttgatggaagaaataaaaaattttacgcagactccgtagaagggccgattcaccatctccagacgacccctccaaccataccgctgtactcctaccaaatagaactatggtagactagttagaaagacgacggactaaactttatttattggtagacgaaagtntttcggtttggtcgagctatcaatgtaggagtaggggtgcgtacgaccaccggtggggaccaagggaaccacgtggtacccaccgttctccctcgacgccctacccgaaccgaaccgggccctacgttccggttccccttcccccgtcggcccctaccccgttccctacccgaacggtccgaccctacccgg

SEQ ID NO: 43683 - DNA, 640 bp, Homo sapiens
  misc_feature: GYAE6OF02GUGBL.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaatttacgcagactccgtgaaggccgattcacatctccagacgacccttccaaccatacgctgtatctaccaaatgaacatggtgacagttgaaagacacgctaaacttattatgtagacgtaaaagtatttcgttaggttcgagactaatacaaagtggtaggtaagtaggggtcgccttacggaacctaccggtgggggaccaaggggaacctaccgttacgggtccaacccggttcctcccttacgaacggtcccctaccgaaccgaaccggggcccctaacgttcccgggttcccctttaccccccggtgggaccccctaccccgttccccgtacccgaaacggtaccgtacccctaaccccgg

SEQ ID NO: 43684 - DNA, 611 bp, Homo sapiens
  misc_feature: GYAE6OF02GLG69.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaaattttacgcagactccgtgaagggccgattcaccatctccagacgacccctccaaccatacgctgtatctccaaatgaacatggtgacagttgaagacacgacaacttattattgtagacgaaagtatttcgttagggtttcgaaggcaattacaattggtaggtagtaggggttggcttcgaactacccgtgggggacccaaggggtaaccacgttggtaccgtacccgttctccctcacgtccctacccgaccgaacggggcccctagttcccgggttccctttcccccgtcggtacccaccccgttccctaccgaacggtaccgcctaaccccgg

SEQ ID NO: 43685 - DNA, 763 bp, Homo sapiens
  misc_feature: GYAE6OF02HG0CD.31.14.B03.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagttgggctgagctgggtttcctcgttgctctttaagaggtgtccagtgtcaggtgcacctggtggaatctggggaggcgtggtccggcgtgggggtccctgagactctcctgtgccatgtctgcgtctgaattcatcctcaggcactagtggctatgcncgtgggtcccncaggccccaggcgaagggtactgggagtggggtcgactagtttatactaagtttagagtggacgaaattaaaaaacgttttacgacaagactccgtaggaagggtaccgattcgaaccattaccnccaagagacccctttaccaaaccctagtaaccncgttacgtactacctaacctaaatacggaaactaacgtaggtacgtaaccgtaagtttcgaaaacggtactaaccgggactaaacctttaaacgttattttaccggagtaaaccgaaaggtaacttttccgggtttaggttaccgtagactacttagtaaacgttggttaacgggtagttaaggggtcggtaccttacggaacctaccggttaaccggggccggttaaagggaaaccgtacgttaggttacccgaaccgttccgtccttaaccggattccccgtacccaacccgtaacgggaccccttaacggttcccgtacccgttttacccccacggttaacccaccccggtttacccgtaacccaacggttaccacccgttaaccccgg

SEQ ID NO: 43686 - DNA, 584 bp, Homo sapiens
  misc_feature: GYAE6OF02GR4DH.31.14.B03.1.454.CMB.1.raw
  modified_base (188)..(188): a, c, t, g, unknown or other
  misc_feature (188)..(188): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (507)..(507): a, c, t, g, unknown or other
  misc_feature (507)..(507): n is a, c, g, or t
  modified_base (575)..(575): a, c, t, g, unknown or other
  misc_feature (575)..(575): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcactgggtcccgccaggccccaggcaagggactgggagtggggtgctatttatactaatttgatggagaattaaaaaattttacgacagactccgtgaagggccgattcaccatcctaccagacgtaccccttaccaacccataccgctgtatcctacaaatgaacatggtgactagttgaagacacggactaacttattatgtagacgaaagtntttacggttggttacganctatcaagtgtggtagtagggtgctaccgacaccggtcgggccgagggaactcgtaggtccaccgtctccncacgcctccgaccgacggccctagtccggttcccttcccccgtggccctacccgtccctaccacgtcncctacccgg

SEQ ID NO: 43687 - DNA, 553 bp, Homo sapiens
  misc_feature: GYAE6OF02I6YKQ.31.14.B03.1.454.CMB.1.raw
  modified_base (213)..(213): a, c, t, g, unknown or other
  misc_feature (213)..(213): n is a, c, g, or t
  modified_base (399)..(399): a, c, t, g, unknown or other
  misc_feature (399)..(399): n is a, c, g, or t
  modified_base (485)..(485): a, c, t, g, unknown or other
  misc_feature (485)..(485): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaagggctggagtgggtggcatttatacaatttgatggagataaaaatttacgcagactcgtgaagggccattcaccatctccagagaccccttccaaccatacgctgtatctccaaatgaacatggtcgacaggttgaagacacggactaacgttattattgtgacgaaagtnttcgttggttcgagtctagtctaatgtaggatagggtgtctcggacaccgtgggaccagggaacacgtggtaccaccgttctcctnacgccctccaccgaacggccctagtccggtccttcccctggccctaccctccaccacgcgctacccgg

SEQ ID NO: 43688 - DNA, 662 bp, Homo sapiens
  misc_feature: GYAE6OF02GORBJ.31.14.B03.1.454.CMB.1.raw
  modified_base (260)..(260): a, c, t, g, unknown or other
  misc_feature (260)..(260): n is a, c, g, or t
  modified_base (387)..(387): a, c, t, g, unknown or other
  misc_feature (387)..(387): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccacggcccccagggccaagggactgggaggtgggtggctatttanacaatttgatggaagtaattaaaaaattttacgacagactccgtaggaacgggccgtattcaccatctaccagacgtacccttaccaacctactacgctagtactcctaccaaatacgaacattggnaacgagttagaagacacggactaaacttatttattcgtaggacgtaaaagtgtttcggttaggttcgagtactaatactaagttggtagggtagttaggggtcgtacgtacgaccgtacccgtgggggacctacgggaaactcgtcgggtacctaccggtcctccgtaccaccggcccttaccgaccgtaaccggggcccctaacgtcccggttccccttacccccggtcggtaccctacccctccgtaacccgaacgtaccgtccctaacccgg

SEQ ID NO: 43689 - DNA, 663 bp, Homo sapiens
  misc_feature: GYAE6OF02HG7O0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactgggagtgggtggctatttatacaatttgatggagtaattaaaaattttacgctagactccggtagaagggccgattcaccatctccagacgtaccccttccaaccatacgctgtactcctaccaaatacgaacagttggtagaactagttagaacgacacggactaactttattattgtagacgtaaagtgtttacggttggttacgagtcatactaaagtgtaggtaagtaggggtcgtcgtaccgacgcccggtggggacccgagggaacctacgtacggtcctaaccggttcctacccgtcgaccgtccctacccgaaccggtacccgggccctaacggttcccgggttcccccttcccccggtccggtaccccctaacccccgttccccgtaacccgaacggtacccgtacccgtaccccggg

SEQ ID NO: 43690 - DNA, 580 bp, Homo sapiens
  misc_feature: GYAE6OF02GSX3T.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaattttacgcagactccgtgaagggccgattcaccatctccagacgaccccttacaaccatacgctgtatctaccaaatgaacatggtgactagttagaagacacggactaactttattattgtgacgaaagtattcgttggttacgagtcatcaatgtggatagggtgctcgacaccgtggggaccagggaaccacgtggtaccaccggttctccgtcacgccctaccgaccgaacgggcccctaggttcccggtccttccccccgtggccctaccccgtcctacccgaacgccgaccctacccgg

SEQ ID NO: 43691 - DNA, 721 bp, Homo sapiens
  misc_feature: GYAE6OF02GPK2I.31.14.B03.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacattgatgganaataaaaatttcgcagactcgtgaagggccattcaccatctccagacgacccttccaaccatacgctgtatcctaccaaatcgaactagtgggtacgaactaggttagaaagaccgaacggtactaaactttattaacgtttgtacgaacggtaaaagtacgtttacgggtttagggttacgaaggtctaattacgaaagttgggtagggtaaggttagggggttggtaccgttacggaacccgtaccggttcggggggacccgaagggggtaaaccctacggttcgggtaccctaacccggttccgttaccccgtacgtaaccgtccccgttaccccgaaacccggtaaccggggtccccctaaggttccccgggttacccctttacccccccggtagggtaccccctacccccgttcccttaaccccgaacgggtacccgacccgtaaccccggg

SEQ ID NO: 43692 - DNA, 835 bp, Homo sapiens
  misc_feature: GYAE6OF02GRUHQ.31.14.B03.1.454.CMB.1.raw
tcagcagtagacgtcacgaccggtgctcgatttagtgtgagtagtttgggctgagcgtggtttctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggcccccagggccaaggggactgggaggtggggtggcattttataactaattttggatggaagtaaacttaaaaaaagttttacgacaggaccttacccggtaggaacggggccgaatttacccaacctattcctaccaaggaccgtaccccctttaccgaaaccctactaacgtccttagttactaccctaaccaaattacgaaaccagttagggtacgaactaggttacggaaacggaacctaaccgggtaccttaaaacttttacgtttaagtttaggtacggtacggtaaaaggttcggtttttacggtttaggggtttaaccggtaagtcctaaacgttacgtaaagtttgggtagggtaagtttaacggggggttcgaccgttaccgaaccgtaacccgggttcggggggaaccctaaacgggggtaaccctacggtttacggggtacccgttaacccggttcccgttaccccttaaccgacccgtaccccgttccccgaaacccgggaccggggtaccccctacggttccccgggttacccctttcccccccggtaggtacccccctacccgttacccccgtaacccaacggtacccgtacccgtaccccgg

SEQ ID NO: 43693 - DNA, 640 bp, Homo sapiens
  misc_feature: GYAE6OF02HQJTA.31.14.B03.1.454.CMB.1.raw
  modified_base (214)..(214): a, c, t, g, unknown or other
  misc_feature (214)..(214): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggctattatacaatttgatggagataaaaattttacgacagactcgtgaagggccgattacaccatctccgagagacccttccaacatacgctgtatctaccaaatcgaacatggtagactagttagaagacaacgggactaacttattaattgtagacgtaaaagtntttcggtttaggttcgagctaagttcaaagttgtaggtagtaggggtggtccgtcggaacacccggttgggggcccgtaaggggaacctacgtgggtaccaacccggttcctacccgtcgacgtcccgtacccgacgaaccgggccctaacggttcccggtccctttaccccccgtgggtaccctaccccgttacccgttaccccaacggtaccgcccgtaaccccgg

SEQ ID NO: 43694 - DNA, 651 bp, Homo sapiens
  misc_feature: GYAE6OF02FT80A.31.14.B03.1.454.CMB.1.raw
  modified_base (245)..(245): a, c, t, g, unknown or other
  misc_feature (245)..(245): n is a, c, g, or t
  modified_base (551)..(551): a, c, t, g, unknown or other
  misc_feature (551)..(551): n is a, c, g, or t
  modified_base (569)..(569): a, c, t, g, unknown or other
  misc_feature (569)..(569): n is a, c, g, or t
tcagcagtagacgtcacgaccggtgctcgatttagtgtgagtagtttggggacgtcgacgctgggttttcctcggttcgctcttttaagaggtgttccagtgtcaaggtgtcaccctgggtcggaatctgggggagccgtgggtcccggcgtgggggtcccctggacgacctctcctcgtgccgatgtctcgccgtacgtcgaattcgatcctccaggccacgttatggcatgcgactgggtccncgacggtccccaggtcaagggacctggacgtgggtgcatttagacaatttgatggtagataaaaatttcgactagactccgtagacggcgtagttcaccatctccgagtacgacccttacgaaccagtacgactgtaactctaccaaagtcgaacactacggtagtacctaggtttcgaaacgacctaccggtacctaaacctttatttacgttggtagtacggtaaagtcgtttcggttgggttacgaggctagtacgaagtggtaggtaagtagggtgctcgactaccgtggggaccagggacncgtggcaccgtctcctcncgtcctccaccgtaacgggccctaagttccggtaccttcccccgtaggccctacccgtccctaccaacggtcgcctacccgg

SEQ ID NO: 43695 - DNA, 579 bp, Homo sapiens
  misc_feature: GYAE6OF02F7JY3.31.14.B03.1.454.CMB.1.raw
  modified_base (252)..(252): a, c, t, g, unknown or other
  misc_feature (252)..(252): n is a, c, g, or t
  modified_base (410)..(410): a, c, t, g, unknown or other
  misc_feature (410)..(410): n is a, c, g, or t
  modified_base (504)..(504): a, c, t, g, unknown or other
  misc_feature (504)..(504): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaattaaaaaattttcgacagactccgtgaagggccgattcaccatctccagacgacccttaccaaccatacgctgtatcctaccaaatgaacagtggtgactagttagaagacacggactaacttattattgtgacgtaaagtntttcgttggttcgagtcattacaagtgtaggagtagggtgcttcgactaccggtcgggaccaagggactacgtggtaccaccgtctcctcgacnccctaccgaccgaacgggcccagtccggtcccttcccccgtgaccctacccctccacccgacgcgacctacccgg

SEQ ID NO: 43696 - DNA, 811 bp, Homo sapiens
  misc_feature: GYAE6OF02H753N.31.14.B03.1.454.CMB.1.raw
tcagcagtagacgtcacgaccggtgctcgattttagtgtgagtagtttgggctgagcgtggtttcgtcgttaggctcttttaagaggtgtccagtgtcaggtgcacctggtggaatctgggggaggcgtggtccggccgtggggggtccctgagactctcctgtgccatgtctgcgtctgaatttcatcctcgaggcactagtggcatcgactacgtgggtcccgccgaacggcccccagggaccgaagggggtactgggaggtggggttggcttaagttttataactaagttttggaagttggtaaggtaaaatttaaaaaaacgttttccggactaacgtaccgttaccgggtacggtaaacggggtcccgtaattaccccaaccgtacgttcctacccgtaaggtacccgttaacccccttacccaaaccctaagttaccgctttacgtactcctaacctaaatacggaaactagtacggtagacgtaggttacgaaacgaccgtacgtactaacgtttattagtttacgtagtacgaaggttactttccgggttaggtacgaagtacaacgttacgtaaagttcggtaggtaggttaacggggtcggtacccttaacggaccggtaaccgggtcgggggtaaccgaaacgggtacctacgggtcggttacccgtaaccgttcccgtccgtacgtaccgtaccccgtacccgaaccggtaaccgggccctaaccggtttccggtacccccgtttccccgaccggttccctacccctacccgttaccaaacggcccgtctaccccgggg

SEQ ID NO: 43697 - DNA, 549 bp, Homo sapiens
  misc_feature: GYAE6OF02F91PM.31.14.B03.1.454.CMB.1.raw
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagaataaaaatttacgcagactccgtgaagggccgattcaccatctccagacgaccccttccaaccatacgctagtatctaccaaatgaacatggtnactagttagaagacacggactaacttattattgtagacgaaagtatttcggttggttcgagcaatcaatgtaggatagggtgctcgacacgtgggccagggacacgtggcaccgtcncctnacgcctaccacgacggcccatccggtccttccccgngacccacccctcctaccacgacgcctacccg

SEQ ID NO: 43698 - DNA, 631 bp, Homo sapiens
  misc_feature: GYAE6OF02FQD4S.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaatttacgacagactcgtgagggccgatcaccatctccagacgacccttccaaccatacgctgtatctacaaatgaacatggtgacagttagaagacacggacaacttattattgtagacgtaaagtactttcgttgggttcgagtctaatcaaagtgtagggtagttagggggtcgccgtacgaacctacccggttacgggggacccaagggggacctaacgttgggttacccgaacccggttccttacccgtcgacgcccctacccaacccggaacggggtcccccaagttcccggttccctttccccccgtggtacccctacccttccccgttacccgaagtccgacctaccccg

SEQ ID NO: 43699 - DNA, 632 bp, Homo sapiens
  misc_feature: GYAE6OF02FP20N.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccaggcaagggactggagtgggtggctatttanactaatttgatggaagaattaaaaaattttacgacagtactccggtagaagggccgattcaccatcctaccagacgacccttaccaaccatacgctgtatctaccaaatcgaacatggtcactagttagaacgacgacggactaacttattattgtagacgtaaagtagtttcggttggttcgagctagtacaagttggtacggtagtaggggtcgctacgacgtaccggtcgggaccaagggactacgtggtacctaccgttcctcccgtacacgtaccctacccgaaccgaacgggtcccctaacggttcccggttccccttacccccgtcggtaccctaccccgtccctaaccggacgtaccgaccctacccgg

SEQ ID NO: 43700 - DNA, 560 bp, Homo sapiens
  misc_feature: GYAE6OF02IF6KD.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactggatgggtggcatttanacaattttgatggagataaaaaaattttacgacagactccgtgaagggccgattcaccatctccagacgacccttccaaccatacgctgtatctaccaaatgaactatggtagacagttagaagacaacgacaactttaattaatttgtgacgaaagtattcgttggttcgagcatcaatgtgatagggtgctcgacaccgtgggaccagggacacgtggtacaccgtctctcacgcctaccaccaacgggcccacgtccggtccttccccgtggccaccctccctaccaacgtaccgctaccccgg

SEQ ID NO: 43701 - DNA, 755 bp, Homo sapiens
  misc_feature: GYAE6OF02HHXIP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtccgccacggccccaggcgaagggctgggagtgggtgctatttatactaatttgatggagtaaattaaaaaattttacgacacgtactccggtaggaacgggccgtaattcaaccacttctaccaagtaccgaccccttaccaacctataccgtctgttactacctaccaaactagaaacagttggtacgaactaggttagaacgaacgacggtaactaactttaatttagttggtacgacgtaaagtacgtttcggttaggtcgaagtactatactaagttggtaggttaggtagggttcgggtctaccggtacgtacccggtaggggaaccgaacggggaaccgtaccgttcggtaacccgttaacccggttccttacccgtaccgtacccgtaccccgtaccccgaaccggtaaccccggggtaacccctaccggtttaccccggtttacccccgtttccccccgggttacgtacccccccgttacccctaacccccgtaacccggtaaccgggtacccgtaccccggttaacccccggg

SEQ ID NO: 43702 - DNA, 797 bp, Homo sapiens
  misc_feature: GYAE6OF02IYSZN.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactcgggtccnccaggccccaggcaagggactgggagtgggtgctatttanactatttgagtaggagtaataaaaatttacgacagacctcgtaggaacgggcctattcaccatctaccagacgtacccttaccaacctataccgctacgtactcctaccaaatcgaacagttacggtgtaactaggttacgaacgaacgaaccgggtactaaaccgtttaatttacgtttacggtacggtaaccgtaaaaggtttacgtttaccgggtttacgggtttacggaacgtacctaagttaaccgaaggtttcgggtaaggggtacggtttaacgggggttcgggtacccggttacggtaacccgtacccgggttacggggggacccgtaaagggggtaaaccctacgttaccggggttacctaaccccggtttcccgtccccgtaaccgtaccggtaccccctacccgaaaccccggtaaccggggtcccccttaaacgggttccccgggtttaccccgtttcccccccgtacggggtacccccttacccccggtcccgttaaccccgaaccggtaccgtccccgtaaccccggg

SEQ ID NO: 43703 - DNA, 601 bp, Homo sapiens
  misc_feature: GYAE6OF02IRD0Y.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatactaatttgatggagtaataaaaaattttacgacaagactccgtagaacgggccgattcaccatcctccagacgtacccttaccaaccatacgctgtactctaccaaatacgaacatggtagacagttagaagacacgactaaacttattaatttgtgtacgaaagtagtttcggttaggttacgagtacatacaatgtaggtagtagggtgctacgacacggtgggaccgagggaactacgtggtacctaccgttctaccctcgacgcccttaccgaccgtacgggccctacgtccggtccttccccgtcgccctaccctccctaccgaacgccgtcctacccgg

SEQ ID NO: 43704 - DNA, 567 bp, Homo sapiens
  misc_feature: GYAE6OF02F81U9.31.14.B03.1.454.CMB.1.raw
  modified_base (253)..(253): a, c, t, g, unknown or other
  misc_feature (253)..(253): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagaataaaaatttacgcagactccgtgaagggccgattcaccatctccagacgacccttccaaccatacgctgtactctaccaaatgaaacatggtgaacagttagaaagacacggctaaacttattattgtgacgaaagtatttcggttggttcgagcatcaatgtaggataggggtgctcgacaccgtggggaccagggaacacgtggtcaccgtctcctcacgcctaccaccgaacgggccccattccgggtccctttcccccgnggcccacccctcctccaacggtaccgcctacccg

SEQ ID NO: 43705 - DNA, 582 bp, Homo sapiens
  misc_feature: GYAE6OF02HN010.31.14.B03.1.454.CMB.1.raw
  modified_base (252)..(252): a, c, t, g, unknown or other
  misc_feature (252)..(252): n is a, c, g, or t
  modified_base (494)..(494): a, c, t, g, unknown or other
  misc_feature (494)..(494): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagaataaaaatttcgacagactccgtgaaggcattcacatctccagacgacccttccaaccatacgctagtactctaccaaatcgaacatgggtacgaactagttagaagacgaacggtactaacgttattagttgtagacgtaaagtatttacggttaggttcgagctaatcaagtggtagtagtagggtgctcgacaccgtgggacaggacacgtgctaccgtctccncacgcctaccgaaccacgggcccacgttccggtacccttcccccgnggtaccctaccccgtcctacccgaacgccgtaccctacccgg

SEQ ID NO: 43706 - DNA, 611 bp, Homo sapiens
  misc_feature: GYAE6OF02FUAP9.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccnccaggccccaggcaagggctgggagtgggtggcagtttatacatttgatggagaataaaaattttacgacagactccgtgaaggccgattcaccatcctccagacgacccttaccaaccatacgctgtatctaccaaatgaacatggtgacagttgaagacacggactaacgttattactttgtgacgtaaagtatttcgttggtttacgagtcatacgaagtgtaggtagtaggggtgtacgtcgacgtaccgcggggtaccgagggtaacctacgtcggtacctaccggttcctcccttcgacgcccttacccaacccgaacgggtccccaacgtcccggttcccttcccccgtgggaccctaccccgtccctacccgaacgcgtaccctacccgg

SEQ ID NO: 43707 - DNA, 558 bp, Homo sapiens
  misc_feature: GYAE6OF02FPZ55.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtggcatttanacaatttgatggagataaaaaattttacgcagactccgtgaagggccgattcaccatctccagacgacccttccaaccatacgctgtatctccaaatgaacatggtgacagttgaagacacggctaacttattattgtgcgaaagatttcgttggttcgagcatcaatgtaggatagggtgctcgaccaccgtggggccagggaaccacgtggtccaccgtctcctcacgccctccaccgaacgggcccagtccggtcccttcccccgtggcccaccccgttccctacccgaagtacgcctacccg

SEQ ID NO: 43708 - DNA, 852 bp, Homo sapiens
  misc_feature: GYAE6OF02G6HB5.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctgagactctcctgtgccatgtctgcgtctgaattcatcctcaggcactatggcagtgcacgtcgggtcccgccacggccccaggccgaagggactgggagtggggtggctatttataactaatttgagtaggaagtaaattaaaaaagttttacgacaagtacctccggtaggaacgggccgtaattaccaacctattcctaccgaagtaaccgtaaccccctttaccaaacctaactacgtcttacgtaacttaccttaaccaaaatacgaaacgtagttacgggtagtaaccgtaaggttaacggaaacgtaaccggtaaccggtaaccttaaaccgtttaaagttttaacgtttaggtaacgggtaacgaaaagggtttacgttttaccgggttttagggtttaaccggaagttaccgtaaacttacgtaaaggttgggttaagggttaagttacgggggttacggaccgttaccggaaccgtaccgggttacgggggaacccgtaaaggggaacccgtaccgttcgggtaacccgtacccgtttccctacccgtaccgacccgtaccccgttacccgaacccggtaacccggggtaccccttaccggttaccccggttcccccgttaccccccggttacgggacccccttacccccgttacccgttaacccggaaacggtacccgacccgttaaccccggg

SEQ ID NO: 43709 - DNA, 589 bp, Homo sapiens
  misc_feature: GYAE6OF02HEJ43.31.14.B03.1.454.CMB.1.raw
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (495)..(495): a, c, t, g, unknown or other
  misc_feature (495)..(495): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtccgccaggccccaggcaagggactggagtgggtgcatttanacaatttgatggagataaaaaattttagcagactcgtgaaggccgattcacatctccaganacccttccaaaccanaacgctagtactctaccaaaatgaaacataggtnacagttgaagacacggcaaacttattattgtagacgaaagtacttacgtttaggtcgagactagtacaaagtgtaggataaggggtgcttcgaacaccgtggggccaagggaacacgtggtaccaccgttctccncgaacgccctaccaaccgaacgggccctaacgttcggtaccctttccccccgtaggccctacccgtccctacccaaacggtacgcctaacccgg

SEQ ID NO: 43710 - DNA, 853 bp, Homo sapiens
  misc_feature: GYAE6OF02HJ6J0.31.14.B03.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctgagactctcctgtgccatgtctgcgtctgaattcatccctcaggcactatggcatgcacgtcgggtcccnccacggccccaggcgaagggactgggagtgggtgctaatttatactaatttgagtaggaagtaaattaaaaaattttacgacaagtactaccgtaggaacgggtccgtaattccgaccattcctaccgaagaccgtaaccccttaccaaaccactaaccgcttacgttaactacctaaccctaaaatacgaaacctagtaggttagaaccgtaaggtttacgaaacgaaccgtacgggtaaccttaaacgttttaatttaacgtttggtaacgtaaacggtaaaggtttacgtttaccgggttttacgggttaacggaacggttactaacgttaccgtaaaagttcggttaagggtaaggttacgggggtacgtaccgtaaccgaaccgtaccgggttacggggacccgaaggggtaaacccgtacggttaccgggtacccgttaacccgttaccttaccccgtaaccgtacccggtacccccttaccccgaaaccccgggtaacccggggtacccctaacccgggttttcccgggttaccccctttaccccccccgggttacgggtaccccccttaaccccccgttccgttaacccccggaaacggtaccccgtacccggtaacccccggg

SEQ ID NO: 43711 - DNA, 728 bp, Homo sapiens
  misc_feature: GYAE6OF02I5EBU.31.14.B03.1.454.CMB.1.raw
  modified_base (261)..(261): a, c, t, g, unknown or other
  misc_feature (261)..(261): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggcccccagggcaaagggactgggagtgggtggctatttanactaatttgatggagaattaaaaaattttcgacagactccgttgaagggccgattcaccatctccagacgaccccttaccgaaccatacgctgtatcctaccaaatagaacatggtagactaggtttagaagacgacgggtactaaacgtttatttaatttgtagacggtaaagtactttcggtttgggttacgaggtctagtacctaagttgttgggtaagtaggggttcggccgttacggaccgtaccggttcgggggacccgaaggggaacctaccggttcgggttaccgtacccggttaccctttcccgaccgtccgtaccccgttacccgaaccccgggtaaccgggtccccctaacggttaccccgggttcccccgtttaccccccggtaccggggtaccccctaacccccgttaccccgttaacccggaaccggtacccgtaccccgttaacccccgggg

SEQ ID NO: 43712 - DNA, 743 bp, Homo sapiens
  misc_feature: GYAE6OF02FGBIY.31.14.B03.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggcccccaggcaagggactgggagtgggtggcatttatacaatttgatggagaataaaaatttacgcagactccgtgaagggccgattcaccatctccagacgacccttccaaccatacgctgtactactccaaatgaacatggtgacagttacgaagacgacggactaactttatttaacttgtgacgtaaaagtntttacggttggtttacggagtacctaagttaccaaagttggttgggtaagttaggggggttacggcccgttacgaaaccgacccgttagggggggaccccaaggggggtaaaccccaccggtttacggggttaccccgtaaccccgggtttcccttaccccgttaccgaacgtcccccctttacccgaaaccccggtaaaccgggggtcccccctaacggtttcccccgggttacccccgttttcccccccccggtttagggacccccccttaccccccggttaccccgttaacccccgaaacgggtaccggtccccctaacccccggg

SEQ ID NO: 43713 - DNA, 809 bp, Homo sapiens
  misc_feature: GYAE6OF02ILHON.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtcctgagactctcctgtgccatgtctgcgtctgaattcatccctcaggcactagtgcatgcacgtcggggtccaccgacggccccagggcaaacggggtactgggaggtcgggtggctattttacaaccaagttttgagttacggagtaaactaaaaaagttttacggcaggtacttacccggtaggaagggtcccgtaattcctaaccgacttccgtcccaaaaggtccgacccctttaccaaaacccttacaacggtcccgttagtaactttcctaaccccgggaaaagtttcgaaaacccttaacggttacggtaacggtaacggtaaacttttcggaaaaagggcctttaaacccgggactaaacgttttaaacgtttaccttttacggtcccgagggtaaataccggtttaacgttcgggtttaaagggccgtacgtacttaactaaacgttggtaaggttaagtcgggttaacccgggaatcggttaacccgacggtttcgggggaccctaaagggtccaaacccggtaggtacccttaccgggtaccgtaccgggttaaacccaccgtaccgtaccgtaccgtaccggtaccgtaccgtaccgtacccgttcccgtccgtacccgtacccgtacccgtaccgtacgtaccgtaccgtaccg

SEQ ID NO: 43714 - DNA, 556 bp, Homo sapiens
  misc_feature: GYAE6OF02FJORU.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (407)..(407): a, c, t, g, unknown or other
  misc_feature (407)..(407): n is a, c, g, or t
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccncacggccccaggcaagggctggagtgggtgctatttanacaatttgatggagtaattaaaaaatttcgcagactccgtagaacggccattcaccatcctccagacgacccttccaaccatacgctgtatctaccaaatgaacagtggtgacagttagaacgacacggctaactttattattgtgacgtaaagtntttcggttggttcgagctaatcgaagtggtaggtaagtagggtggctcgacgaccgtgggaccagggacacgtggtcctaccgtctcctcacgcctaccacgacggccagtccgtccttccccgngcctaccctccacacgcnctaccg

SEQ ID NO: 43715 - DNA, 640 bp, Homo sapiens
  misc_feature: GYAE6OF02GY018.31.14.B03.1.454.CMB.1.raw
  modified_base (430)..(430): a, c, t, g, unknown or other
  misc_feature (430)..(430): n is a, c, g, or t
  modified_base (600)..(600): a, c, t, g, unknown or other
  misc_feature (600)..(600): n is a, c, g, or t
  modified_base (609)..(609): a, c, t, g, unknown or other
  misc_feature (609)..(609): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggcaagggctgggagtggggtggcatttatacaatttgatggagaattaaaaatttacgacagactccgtaggaacgggccgtattaccaccatctccagactaccccttccaaccataccgctagtactctaccaaatgaacagtggtagactagttacgaaagaccgaacggtactaactttattattgtacgacgtaaagtntttacggttgggttacgagtactatactaatgggtagtaaggttagggtgcctcgacctaccgggtggggccgaacgggaacctcgtcggtacccaccgtttcccgccttacacccggtcctacccgaaccgtaaccgggccctaacgttccgggtccccttacccccgnggtaccccncccgttcccgaccaacggtcgaccctcccgg

SEQ ID NO: 43716 - DNA, 687 bp, Homo sapiens
  misc_feature: GYAE6OF02GD021.31.14.B03.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtggctagtttanacatttgatggagataaaaatttcgcagactcgtagaaggccgattcacatctaccagacgaccttaccaaccatacgctagtactctaccaaatgaacagtaggtagaactaggttacgaagaactacggactaaactttattacttggtcgaacgaaagtactttcggttacgggtttcgagtaccaattaccgaatggttaggtaagtacggggttgtacgtacgaacctccggtacggggtacccgaaggggtaacctaaccggttacggtaccgtacccggttcttacccgtacgaaccggccccttacccgaacccggtaaacgggtcccccgtaaacgttacccgggttccccgttacccccctaggggtcccccttaaccccgttaccccgaacccgtaacggtaccggtacccttaaccccggg

SEQ ID NO: 43717 - DNA, 689 bp, Homo sapiens
  misc_feature: GYAE6OF02ILL0L.31.14.B03.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttggggacgtcgagctgggttttcctcgttagactcttttaagaggtgtccacgtgtcaggtgtcacctggtcggaatctggggagcgtggtccggcctgggggtccctgagactctcctgtgccatgtctgcgtctgaattcatcctcaggcactatggcatgcactgggtccnccaggcccccaggccaagggactgggagtgggtgctatttanacaatttgatggagataaaaatttacgcagactccgtgaaggccgattcaccatctccagacgacccttccaacatacgctgtatctaccaaatgaacatggngacagttagaagacaacggactaacgtttattagttgtacgacgtaaagtacgtttcggttaggttacgaagtactaattacgtaaagttggttaggtaaggttaaggggtcggtaccgttaccggaccgaccggttacgggggaccctaaaggggtaaccctacggttacggtacccgacccgttccgttacccgtaccgaccgtccccgtaccctaaaccggtaccgggaccccttaacggttcccgggttacccttccccccgtacggtaccccgttacccccttacccgttaacccgaacgtaccgacccttaccccggg

SEQ ID NO: 43718 - DNA, 625 bp, Homo sapiens
  misc_feature: GYAE6OF02HBGJG.31.14.B03.1.454.CMB.1.raw
  modified_base (214)..(214): a, c, t, g, unknown or other
  misc_feature (214)..(214): n is a, c, g, or t
  modified_base (468)..(468): a, c, t, g, unknown or other
  misc_feature (468)..(468): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggccaagggactggagtgggtgctatttatacaatttgatggagaataaaaaattttacgacagactccgtagaagggccgtattcaccatctccagacgaccccttccaaccataccgctgtactctaccaaatcgaactagtggtagactagttagaagacgacgactaacttattattgtagacgtaaagtatttcgttggttacgagtctatctaatggtagtagtagggtgactcgacnccggtacgggccagggactacgtcggtaccaccgtcctacccgtcaccgtccctaccgaaccgtaaccggggtcccctacgttcccgggttaccccttccccccgtcgggtacccctaccccctcccgtacccgaaaccgtccgtacccctacccgg

SEQ ID NO: 43719 - DNA, 787 bp, Homo sapiens
  misc_feature: GYAE6OF02HY7DV.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagcagtagacgtcacgaccggtgctcgatttagtgtgagtagtttgggctgagcgtggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtcccnccagggccccagggcaagggctgggagtgggtggctattttanactaatttgaattggaagtaaattaaaaaaatttttacgacaacgtacgtaccggtggaaacgggtccgaatttaccaaccctaattcctaccgaaggtaccgtaccccttaccaaacctacttacgcttagtactctaccaaatcgaacngtgganacgaagttgaacgacgacgactaaacgtttattattgtacgagtaaacgtagttttcggttaggttaccgagtcaagttacgtaaagttggttacgggtaagttacggggtgggtaccttaccggtaaccgaacccggttaggggggccccgaaaagggggtaaaccctacggttaacggggttccctaacccggtttcccgtttacccgtaaccgccggtaacccccttaccccggaacccggtaaacccgggggtccccctaacggtttaccccgggttaccccccgttttccccccggacgggttccccctaacccccggttaccccgtaaccccggtaaaccggtacccgtaaccccgttaccccggg

SEQ ID NO: 43720 - DNA, 567 bp, Homo sapiens
  misc_feature: GYAE6OF02G8GC0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtggggtggcattttatacaatttgatggagataaaaaattttacgcagactccgtgaagggccgattcaccatctccagagaccccttccaaccatacgctgtatctaccaaatgaacatggtgacagttgaagacacggcaaactttattatttgtgacgaaaagatttcgttggttcgagcatcaatgtaggagtagggtggctcgacaccgtggggccaggggaacacgtggtccaccgttctcctcacgtcctcccaccgaacgggcccagttccggtccttcccccgtggtcccaccccttccctcccaacgacgctacccg

SEQ ID NO: 43721 - DNA, 805 bp, Homo sapiens
  misc_feature: GYAE6OF02FS249.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgtaattcactcctcgaggctactagtggctatcgcctacggttcgggtcccgccgaccgggccccgagggaccgaaacggggtacgtggggagggttgggggtcggacttaagttttaactaacttaagttttaggagtagggaaagtaaaatttaaaaaaacgtttttaccggactaacggtaaccgttccggttagggaaacggggtcccgtaactttaccgaaccctacttccctacccgaaggaacccggtacccccttaacccaaaccctacgtaccgtcttacgttaacttcctaaaccaaattacgaaactagttggtacgacgtagttaacggaaacgaccgtacggaccttaaactttatttagttaggtacggaacgtaaagttcgtttcgggtttaggttacgagtctagtactaagttggtaggtaaggttggggtcggccgtacgacctaccgggtcgggaaccggaagggaaccgtacgtcggtaccctccgttcctccgtcgaccgtccctacccgaaccggaaccggtccctacggttccccggttccccttacccccggtcggtacccctaccccgttcccgaacccgaacggtaccgtccctaaccccggg

SEQ ID NO: 43722 - DNA, 580 bp, Homo sapiens
  misc_feature: GYAE6OF02HZNUT.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtggcatttatacaatttgatggagataaaaaattttacgcagactccgtgaaggcgattcacatctcagagacccttccaaccatacgctgtatctccaaatgaacatggtgacagttgaagacacggacaacttattattgtgacgtaaagatttcgttggttcgagcatcaatgtgagtagggtgctcgacaccgtggggaccagggacagtggtccaccgtctcctcgacgccctaccaccgaacgggcccctaagttcccgggtaccctttccccccgtgggtacccctaccccgttacccctacccgaaacggtaccgacctacccccgg

SEQ ID NO: 43723 - DNA, 643 bp, Homo sapiens
  misc_feature: GYAE6OF02F2YLF.31.14.B03.1.454.CMB.1.raw
  modified_base (253)..(253): a, c, t, g, unknown or other
  misc_feature (253)..(253): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggccaagggactggagtgggtgcatttanacaatttgatggagataaaaattttacgcagactccgtgaagggccgattcaccatctcagacgacccttccaaccatacgctgtatctccaaatgaacatggtgacagttagaagacacggactaaacttattaatttgtagacggaaaagtntttacggtttggttcgaagctaattacgaaatggttagggtaacttaggggttggcttacggaacctaccggttcgggggacccaagggggaaccacgtcgggtaccacccgttcctacccttcgacgccctaccaacccgaacggggtcccctaacgttcccgggttcccctttaccccccgtgggtccccctaaccccgtttccccacccgaaacggtcgtaccctaaccccgg

SEQ ID NO: 43724 - DNA, 710 bp, Homo sapiens
  misc_feature: GYAE6OF02I2TWJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccacggccccaggcaagggactgggaggtgggtggctatttatacaatttgatggagataaaaattttacgcagactcgtgaggcatcacatctcagacgacccttaccaaccatacgctgtatcctaccaaatgaacataggtgactagttgaacgacacgctaaacttattatttgtgacgtaaagtacttcggtttggttacggagactatactaagttggttagggaagtttacggggtggtaccgtccggaaccctaccgggttcgggggacccgaaacgggggtaccgtaaccggttacgggtaccgtaaccccgggttcctttaccccgttaccgtaccgggtccccttaccccgaacccggaaacccggggtcccccgtaacggttacccgggtttcccccgttttacccccccgtccggggtaccccctaaccccccgtttcccccgtaaccccgtaaacgggtacccggtaccccgttaaccccggg

SEQ ID NO: 43725 - DNA, 672 bp, Homo sapiens
  misc_feature: GYAE6OF02GS8PK.31.14.B03.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggctgagctgggttttcctcgttgctcttttaagaggtgtccagtgtcaggtaaagcacctggtggaatctgggggaggcgtggtccggcctggggggtccctgagactctcctgtgccatgtctgcgtctgaattcatcctcaggcactatggcatgcacgtgggtccgccacggccccaggcaagggactgggaggtgggtggctatttatactaatttagatggaagtaattaaaaaattttacgactaagactaccggtaggaagggaccgtattaccacctatctaccagacgaccctaccaaccatacgctagtactctacaatacgaacataggagactagttagaagacaacggactaacttatattgtagacgaaagtnttcgttggtcgagctatacaagtggtaggtaagtaggggtagcgtcgtaccgtaccgtggggaccgtagggaaccgtacgtacggtcctaccgttcctaccgtacgacgtaccccgtaccgtaacccggtaaccggggcccctacggttccccgggttccccgtttcccccccggtacgggtacccctacccccgttacccgtaaccccggaacggtacccgtacccgtaacccgg

SEQ ID NO: 43726 - DNA, 632 bp, Homo sapiens
  misc_feature: GYAE6OF02I188X.31.14.B03.1.454.CMB.1.raw
  modified_base (373)..(373): a, c, t, g, unknown or other
  misc_feature (373)..(373): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggactgggagtgggtggcatttatacaatttgagttggaagaattaaaaaattttacggacagtactccgtaggaaggccgtattcacatctaccagacgacccttcaaccatacgctcgtatctacaaatgaacatggtanactagttagaagactacggactaaactttagtatttagacgtacgaaagtatttacgtttggtcgaagtcatactagtaggtaggagttagggtagcctacgaccaccggtgggaccgtaacggacgtaccgtaggtacctacccgtcgtaccctacgaacgcccttaccgaaccggtaaccgggcccctaagtccccggtttcccgttccccgtaaggtccctacccgtcccttaccgaacgtaccgccgtaacccgg

SEQ ID NO: 43727 - DNA, 589 bp, Homo sapiens
  misc_feature: GYAE6OF02F8VHG.31.14.B03.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (335)..(335): a, c, t, g, unknown or other
  misc_feature (335)..(335): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtccnccaggccccaggcaagggctggagtgggtggctatttanacaatttgatggagaattaaaaatttacgcagactccgtagaagggccgattcaccatctccagacgacccttccaaccatacnctagtactctaccaaatgaacatggtgactagttagaacgacacggactaacgttattattgtgacgtaaagtntttcggttgttagagtanacgtacaatggtggaacgtagggtgccttcgacgtaccgcggggaccagggtaacacgtcggtacgtacctcgtcctcacgtccctaccaccgaacggtccacgttccggttcccttcccccgtggcccctacccgtcccgtaccaacgacgacctacccgg

SEQ ID NO: 43728 - DNA, 561 bp, Homo sapiens
  misc_feature: GYAE6OF02H9C0P.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (471)..(471): a, c, t, g, unknown or other
  misc_feature (471)..(471): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccaggcaagggactggagtgggtgcatttanacaatttgatggagataaaaaattttcgcagactccgtgaaggccgattcaccatctccagacgacccttccaaccatacgctgtatctccaaatgaacatggtgacagttgaagacacggactaacttaattattgtagacgtaaaagtatttcggttaggtttcgagcatacaagtgtggataggggtcgctcgacaccgtggggccaagggaacngtggtcaccgttctcctcacgcctcaccgacggccctagtccggttccttcccccgtggccctaccctcctaccgaacgacgcctacccg

SEQ ID NO: 43729 - DNA, 699 bp, Homo sapiens
  misc_feature: GYAE6OF02H8RKH.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcacgtgggtccgccaggccccagggcaagggctggaggtgggtgctatttanactaatttgatggagtaattaaaaagtttacgactagactccgtgaaggggccgattccgaccatcctaccagacgacccttacaaccctataaccgctagtactcgtaccaaatacgaacagtggtagaactaggttagaaacgcgaacggactaaacgtttattaagtttggtagacgtaaaagtagtttcggttttagggtacgagtacgtaattacgaagttgtaggtagttaggggtcgacttcgacaccggtcggggtaccgaaggggtaaccacggttacgggtacctaacccggttcctcccgaccgtacgtccccgttacccgaacccggaaccggggtccccctacggtttacccggtcccccgttttaccccccgtgggtaccccctacccccgttacccgttaccccgaacggtaccgtcccttaaccccggg

SEQ ID NO: 43730 - DNA, 611 bp, Homo sapiens
  misc_feature: GYAE6OF02F1IRL.31.14.B03.1.454.CMB.1.raw
  modified_base (579)..(579): a, c, t, g, unknown or other
  misc_feature (579)..(579): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggggtccctgagactctcctgtgccatgtctgcgtctgaattcatcctcaggcactatggcatgcacgtgggtccgccacggccccagggcaaggggctgggaggtggggtggctatttatactaatttgatggaagtaaattaaaaaattttacgacagactccgtaggaacgggccattacaccatcctaccagacgaccccttaccaacctactacgctgtactctaccaaatgaactgtggtgaactagttagaagacacggactaaactttattattgtagacgtaaagtgtttcggtttggttacgagtcaatacaagtggtaggagttaggggtgactcgacgaccggtggggaccaagggaccacgtgcctaccgtcctccgtcgaccgtccctaccaccggacggccctacggttccgtcccttccccgngacccacccctccaccgacgacgcctacccgg

SEQ ID NO: 43731 - DNA, 589 bp, Homo sapiens
  misc_feature: GYAE6OF02I8GQG.31.14.B03.1.454.CMB.1.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (410)..(410): a, c, t, g, unknown or other
  misc_feature (410)..(410): n is a, c, g, or t
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccaggccccagggccaaagggctgggagtgggngctatttanacaatttgatggagaattaaaaattttcgcagactccgtgaagggccagttccaccatctccagacgacccttccaacctatacgctgtactctaccaaatgaacatggacgacagttagaagacacggacaacttattatgtgacgtaaagtnttcgttggtacgatactatacaagtgtaggatagggtcgcgtcgacgaccggtgggaccaagggtaacacgttggtccaccgttctccgtacncgtccctaccgacgaacggtccctaagttccggtacccttccccgtggtacccnccccgttactacccgaagtccgtctaacccgg

SEQ ID NO: 43732 - DNA, 713 bp, Homo sapiens
  misc_feature: GYAE6OF02JBTOU.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgctacgtcgggtccnccacggccccgaggacgtaaggcgtggaggtgggtcgtactaatttactaacttaagttgagtaggaagtaaaatttaaaaacgtttcgacgagtaccgtcgtaggaacggctactacactatcacgagaccgtacctacaactactacgtcgtagtactaccaactaatacgaactagtcggtacgaacgtaggtaacgaacgtaaccgacgtaaccttaatttaagtttacgtacggtaacgtaacgtaaacgtttacgtttacggttacggtaacgtacgtacgtaatacgtagtagggtacgttaaagggttacgggtcggtacctaccggaccgtaccggggtacggaaccggtaaagggacctacgtcggtaccctaccgttcctacgtaccgaccgtcccgaccgaaccggtaccggtccctacggttccctccccgttacccgcggtacccctcccttaccgaaccgtacggacccgtaccgtacccgg

SEQ ID NO: 43733 - DNA, 554 bp, Homo sapiens
  misc_feature: GYAE6OF02G353T.31.14.B03.1.454.CMB.1.raw
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaatttacgcagactccgtgaaggccgattcacatctccagagacccttccaacatacgctgtatctcaaatgaacatggtnacagttgaagacacggcaacttattattgtagacgaaagtagtttcgttggttcgagtcatacaatgtggagtagggtgcgtcgacacgtgggccagggacacgtcggcaccgttctcctcacgcctaccgaccgaacgggccccagtccggtacccttcccccgtggccctaccccgtcctacccaacggacncctacccg

SEQ ID NO: 43734 - DNA, 656 bp, Homo sapiens
  misc_feature: GYAE6OF02FZNFO.31.14.B03.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccaggcaagggactggaggtgggtggctagtttanactaatttgatggagtaattaaaaaattttacgacagacctccggtggaacgggccgattccacctatctaccagacgtaccccttaccaaccataccgctgtactctacctaaatgaacagtggtanacgtagttacgaagacgacgactaactttattattgtgacgtaaagtatttcggttaggtacgtagactatactaagtggttaggagttagggtgccgtacggaccgtaccggtggggacccgaagggacctacgttggtcccgtaccgttcctccgtaccacgcccttaccgaacccgtaccgggccctacggttacccggttcccctttacccccggacggtcccctacccgttaccccgtacgaacccggtaccacccgttacccgg

SEQ ID NO: 43735 - DNA, 662 bp, Homo sapiens
  misc_feature: GYAE6OF02JIR0U.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggcgtgagctgggttttcctcgttgctctttaagtaggtgtccagtgtcaggtgcacctggtggaatctgggggaggcgtggtccggcctggggggtcctgagactctcctgtgccatgtctgcgtctgaattcatcctcaggcactatggcatgcactggggtccnccaggccccaggcaagggctgggagtgggtgcatttanacatttgatggagataaaaattttacgctaagactccgtagaaggccgtaattcaccatctaccagacgaaccccttccaaccactacgacttcgtaatcctaccaaatcgaaaccattgggtcaactagttacgaagaacacgggactaaactttaattacgtttagtggaacgtaaatagtttcggttggtacgagacaattacgaaatcggtaaggagttaggggtaggtcctacgaccaaccggttcggggggaccctaaggggtaaaccncgttaggggtcccaacccgtttccgtaccctacgacgccccttccaaacccgaggggtcccccagttcccggttaccccttcccccgaggtaccctaccccgtacccttacccaaacgtcccgtaccctcgggg

SEQ ID NO: 43736 - DNA, 589 bp, Homo sapiens
  misc_feature: GYAE6OF02H3GQC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgctatttatacaatttgatggagataaaaaattttacgcagactcgtgaggcatcacatctcagacgacctccaaccatacgctgtatctcaaatgaacatggtgactagttgaagacacggacaacttatatttgtagcgaaagtatttcgtttggtcgagtcatcaatgtaggagtagggtagcgtacgacaccgtggggacctaagggaaccacgttggtacctaccgttcctccgtacacgtccctacccacccgtaacgggcccctaacgtcccgggttccctttccccccgtgggtaccctaccccgtcccttacccgaaacggtccgcctaaccccgg

SEQ ID NO: 43737 - DNA, 729 bp, Homo sapiens
  misc_feature: GYAE6OF02IRBWO.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcatgcacgtcgggtccnccgacggccccaggcgaagggactggagtgggtgctatttagtactaatttgataggagtaaataaaaaatttcgactagactccggtaggaacgggccgtattacaccatcctaccgaacgtaccgtaccccttaccaacctactaccggctagtactacctaaccgaaatacgtaaacagttaggtacggactaaggttacgaaacgacgacggactaaactttagttacgtttagtacgtaacggtaaagtttacgtttacggtttacggttacggaagtactactagtaaagttggtaagggtagttaggggcgtaccgtaccggaccgaccgggtacgggggacctaaacggggacctacggttacgtaccgttaccccgttcttccctacgaccgtaccccgccgaaccgaccgggtacccctaccggttcccgttcccccgttacccccgtacggtaccccctaccccgttaccccgtacccgaacggtcccgaccgtacccgg

SEQ ID NO: 43738 - DNA, 599 bp, Homo sapiens
  misc_feature: GYAE6OF02H9LKK.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaatttcatcctcaggcactatggcatgcactgggtccgccaggcccccaggcaagggactggagtgggtggcatttanacaatttgatggagaataaaaattttacgcagactccgtgaagggccgattcaccatctccagacgacccttccaaccatacgctgtactctaccaaatgaacatggtagacagttagaacgacacggactaacttattatttgtagacgaaagtatttcgttaggttacgagctaatcaagtgtaggagtagggtgctcgacacgtgggaccaagggacacgtggtaccaccgtctcctcacgccctaccgaccgaacgggcccctaagtccggttaccccttccccccgtgggtacccctacccccgttacccgtacccgaacggtaccgccgtaaccccgg

SEQ ID NO: 43739 - DNA, 726 bp, Homo sapiens
  misc_feature: GYAE6OF02H4TFU.31.14.B03.1.454.CMB.1.raw
tcagcagtagacgtcacgaccggtgctcgatttagtgtgagtagtttgggctggagcgtgggttttcctcgttgctcttttaagagggtgtccagtgtcaggtgcacctggtggaatctgggggaggcgtggtccggccgtggggggtccctgagactctccgtgtgccatgtctgcgtctgaattcatcctcaggcactatggcatgcacgtgggtccgccaggccccaggcaagggactgggagtggggtggctatttatactaatttgatggagtaattaaaaaattttacgacagtactaccgtaggaacgggaccgtattccaaccatcctaccgagacgtaccccttaccaacctactacgcttagtactacctacctaaatacgaactagttaggtgtaacgagtttagaaacgacgaaccggactaactttaacttaagtttcggtagacggtaaaggtactttacgggtttggttacgtagtactaacgttactaagtggtacgggtaggttaaggggtcgtcgttacggacgtacccgggtcggggaccgaagggtaccgaacgtcggtaccgtacccgttccgtacctacgtaccgacccgtacccgaccggtaaccgggcccctaacgttcccggtacccccgtttcccccggtccggtaccccgtacccccgttacccgttacccgaacggtacccggtaccgtaaccccggg

SEQ ID NO: 43740 - DNA, 630 bp, Homo sapiens
  misc_feature: GYAE6OF02IKHRJ.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgtgtctgaattcatcctcaggcactatggcatgcactgggtccgcaggccccaggcaagggactggagtgggtgctatttanacaatttgatggagaataaaaaattttacgcagactccgtgaagggccgattcacatctccagacgaccttccaacatacgctgtatctaccaatgaacatggtagacagttagaagacacggactaactttagttatttgtagacgtaaagtactttcggttaggtttcgagtctaatcaaatggtaggtagttagggttcggacttcggaccgtaaccggtggggaccgaaggggtaacctacggttcggtcctaacccgttcctaccctccgacgtccctacccgaacccgtaacgggccctaaccgtccggttcccctttacccccgtaggcccctacccgtccccgtacccgaacggtccgaccgtaccccgg

SEQ ID NO: 43741 - DNA, 738 bp, Homo sapiens
  misc_feature: GYAE6OF02HYCB3.31.14.B03.1.454.CMB.1.raw
  modified_base (252)..(252): a, c, t, g, unknown or other
  misc_feature (252)..(252): n is a, c, g, or t
  modified_base (311)..(311): a, c, t, g, unknown or other
  misc_feature (311)..(311): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggactggaggtgggtgcatttanacaatttgatggaagaattaaaaattttacgcagactccgtgaaggccgattcacatcncagacacccttccaaccatacgctgtactctaccaatacgaacatggtgacagttagaagacacgacaactttattatttgagacgaaagtatttcggtttagggttacgagtcaattacaaagttggtagggttaacgttagggggtcggacccgttacgggaacccgtaaacccgggttcggggggaacccctaaaagggggggtaaaccctaaccgggtttacggggttacccctaaaccccgggtttcccgttacccccttaccgtaaccgtacccccgttaccccgaaacccgggaacccggggtcccccgtaaacgtttccccggggttaccccctttccccccccggtacgggacccccgttacccccccgttaccccgtaacccggtaaaccgggtaccggtaccccgtaacccccggg

SEQ ID NO: 43742 - DNA, 703 bp, Homo sapiens
  misc_feature: GYAE6OF02GKPMM.31.14.B03.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccgaccacggccccaggcgaagggactggagtgggngcatttanactatttgatggagaattaaaaatttcgacagactccgtagaacggccgtatcacatcctaccagacgacccttacaaccataccgctgtactctacctaaatgaactagtggtacactacgttagaacacgacggtactaactttagttatagtgaacgtaaacgttntttacggttaggtttaccgagtacctaagtaccgtaagtcgggtacggtagttaggggttcggacccgttacggaaacctaccgggttacgggggacctaaagggggtaaccctaggttaccggtaccgtaacccgttccttacccgtaccgtaccgtcccgttacccaacccgggtaaccgggtccccgtacgttaccccggggttaccctttccccccggtaggacccccttaccccgttaccctaacccggaacggtacccgacccgttaacccgg

SEQ ID NO: 43743 - DNA, 579 bp, Homo sapiens
  misc_feature: GYAE6OF02F5UCE.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgaactgggtccgccaggcccccaggcaagggactggagtgggtggcatttatacaatttgatggagataaaaatttacgcagactccgtgaagggccgattcaccatctccagacacccttccaaccatacgctgtatctaccaaatgaaacatggtgactagttgaagacacggctaacttattattgtgagaaagtagtttcggtttggttacgagcaatcaagtgtgggattagggtgctcgactaccgtcggggccagggaaccagtcggtccacccggttctcccgtcagccctccaccgaacgggccccaagtcccggttccctcccccgtcgcccgtacccctcctaccaacgaccgccacccgtccggg

SEQ ID NO: 43744 - DNA, 591 bp, Homo sapiens
  misc_feature: GYAE6OF02HZXS4.31.14.B03.1.454.CMB.1.raw
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtcctgagactctcctgtgccatgtctgcgtctgaattcatcctcaggcactatggcatgcactgggtccgccaggccccaggcaagggactggagtgggtggcatttanacaatttgatggagataaaaaattttacgcagactccgtgaagggccgattcaccatctccagacgacccttccaaccatacgctgtatctaccaatagaacatggtgacagttgaaagacgacggacaacttattaatttgtagacgaaaagtatttcgtttggtttcgaagcaatcaaatgtggattaggggtgcgtcgacaccgtggggccagggacacgtggtccaccgtctcctcagtccctaccgaccaacggggcccctaacgttccggttaccctttccccccgtggtacccgaccccttccctaccccggaaagtaccgccctaaccccgg

SEQ ID NO: 43745 - DNA, 597 bp, Homo sapiens
  misc_feature: GYAE6OF02H9C8K.31.14.B03.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcacttgggccnccaggcccaggcaagggactggagtgggtcgctatttanacgtaatttgagtggagaattaaaaatttacgacagactcgtagaaggcctattcacatctacaganaccttacaacgatacgctgtaatctaccaaagtcgaacagtcggtagaactagttagaaagacacggtcaaactttagttaattgtacgacgaaacgttatttcggtttacggtacgtagacctaagttaccaagttggtaaggactaagggttagccttagacgaccgtgggaccgaagggacacgtcgtcgaacctcgtcacgcgacctcccgaacaccggtccacgtccgtccttccccgtggtacccaccctctaacccgaagcgtaccctaccg

SEQ ID NO: 43746 - DNA, 603 bp, Homo sapiens
  misc_feature: GYAE6OF02HOJB1.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (432)..(432): a, c, t, g, unknown or other
  misc_feature (432)..(432): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgtatcagcctgagacgactatggcatgcactgggtccnccaggccccaggcaagggctggaggtgggtgctatttananaatttgatgganaataaaaatttcgcagactcgtagaaggccattcacctatctccagactacccttaccaaccatacgctgtatctaccgaaatcgaacatgggtagactagttagaacgacacggtactaacgttattaattggagacgtaaagtgtttcgttggtcagtctatnaatggtaggacgtagggtcgccgtacgacgaccggttgggaccgagggtaactactcggggtacctaccgtccttccacgtacccncctaccgacgaccggtccctacggttcccgtccccgttccccgtcgtacccctacccgtacctacccgaacgtacacccgtaccg

SEQ ID NO: 43747 - DNA, 681 bp, Homo sapiens
  misc_feature: GYAE6OF02JUL1S.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtccgccaggccccaggcaagggctggagtgggtgctatttatacaatttgatggagaataaaaatttcgacagactccgtgaaggtccgattcaccatctaccagacgacccttccaaccataccgcttgtactcctaccaaaatgaaacagttaggtacgaactaggtttacgaaagtacacgggtacctaaacgtttaattacttagtacgacgtaaagtatttcggttaggttcgaagtcattacaagttggtacggaagttaggggtcggtaccgtacggaacgtacccggttgggggacccaaggggaaaccctacggtcgggtaccctacccgttcctacccgttcgaccggtaccctacccgaaccggtaaccggggcccctaacggttcccgggttacccctttccccccgtagggtacccccttacccgttacccgtacccgaacgtaccgacccgttacccgg

SEQ ID NO: 43748 - DNA, 654 bp, Homo sapiens
  misc_feature: GYAE6OF02HDLZP.31.14.B03.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (360)..(360): a, c, t, g, unknown or other
  misc_feature (360)..(360): n is a, c, g, or t
  modified_base (600)..(600): a, c, t, g, unknown or other
  misc_feature (600)..(600): n is a, c, g, or t
tcagcagtagacgtcacgaccggtgctcgatttagtgtgagtagtttgggctgagcgtggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggccaagggactgggagtgggtgctatttanactaatttgatggagaattaaaaattttcgcagtactccgtgaaggccgattcaccatctaccagacgacccttaccaacatacgctgtactctaccaaatgaacntggtgactagtgaagacacggcaacttattattgtagacgaaagtatttcgttggttacgagtctaagtctaaattggtagggtaattagggggtacgtccgttaccgaccgtaaccgggttcggggaccggtaacgggaacctaacggtcgggttacccaccggttcctcccgtacgaaccgtccctacccgaaccgtaaccgggtcccctaaggttcccggttcccctttacccccgnggtaccccttaccccgttacccgtacccgaacggtccgttaccctaaccccggg

SEQ ID NO: 43749 - DNA, 704 bp, Homo sapiens
  misc_feature: GYAE6OF02IQRQM.31.14.B03.1.454.CMB.1.raw
  modified_base (565)..(565): a, c, t, g, unknown or other
  misc_feature (565)..(565): n is a, c, g, or t
  modified_base (572)..(572): a, c, t, g, unknown or other
  misc_feature (572)..(572): n is a, c, g, or t
tcagcagtagacgtcacgaccggtgctcgatttagtgtgagtagtttagggtttggggagctacaaccaggcaggcagggctagcaagatggtgttgcagacccaggtccttcctatttcgtcttgttcgctctcggtatacgtcgtggtgcccgttacggggacagttcggtgaactgaagcctacgtttccagacctccgtgctgtcgtctcgtgggtcgagacggccaccgatacaactgactaaggtccagtccagtagttcgttttacgtcggaccccgaccgaaataaccgaacgttaacgttacgtctttacggaccagtactaagttaaagtacgacacgtaaccctacctaaactcctagtactttacgtcggtaccttaccggtacccggctacggttccccgggttaaccctaacgtcttaccgaagttcgaccgtaacggtaccgggtcgtacgggtaccgttactttccgactcctacctaccactccgacgcgtacgtccacgacgacgtctagtacgtgttgaggtacttagtttacttctagtacgtancaacttnttacgttccgtttcgttacgttacgttcgttacggacgggtacggaaccgtaggtacgtagtaacgtaccgtaacgtccgtggaccgtccgtacgaccgtaccgtacgttccttccttcccgttcgtacccg

SEQ ID NO: 43750 - DNA, 622 bp, Homo sapiens
  misc_feature: GYAE6OF02GQI0F.31.14.B03.1.454.CMB.1.raw
  modified_base (256)..(256): a, c, t, g, unknown or other
  misc_feature (256)..(256): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtggggtggctatttanacaatttgatggagaattaaaaatttacgcaagactccgtaggaagggcccgattccaccatcctccagacgaccccttccaaccactacgctgtatctacaaatgaacatggtnacgagttagaagacacggactaacttattattgtcgacgtaaagtatttcggttggttcgagctaatacaatggtaggagtcgggacgcgtacgacgaccgtgggggaccaagggaacctcgtacggtacccgtaccgttcctcccgtacgaccgtccccgtacccgaaccgaacgggtcccctaaggttcccggtcccgttcccccgtggacccctaccccgttccctaccgaacgccgaccctacccgg

SEQ ID NO: 43751 - DNA, 630 bp, Homo sapiens
  misc_feature: GYAE6OF02GBQ4O.31.14.B03.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtgggtccnccacggccccaggcaagggactggagtgggtggctatttanacaatttgatggagataaaaaatttcgacagactccgtagaaggccgattcaccatctccagagaccccttccaaccatacgctgtactctaccaaatcgaaacatggtagactaagttggaaagacacggtacaaactttattattgtagacgtaaagtattcggttggttcgagtcatacaatggtagtagtaggggtgactcgacgaccgtcggggaccaagggaacacgtcggctaacccggtctacctcgacgtccctacccgaaccgtaaccgggcccctaagttcccgggttacccctttccccccgtacgggaccccctaacccccgtttcccgacccgtaaaccgggaccgtaccctaaccccggg

SEQ ID NO: 43752 - DNA, 743 bp, Homo sapiens
  misc_feature: GYAE6OF02FOWKF.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccgacgggcccccagggaccaagggacctgggaggtgggtggctaattttatactaatttgatggaagtaatttaaaaaattttcgacagactccggtagacgggcctattcaccatcctaccaggacgaccccttccaaacctataaccgtctagtactcctaccaaatacgaaactagttgggtagactaggttagaaacgacgtaaccgggtctaaactttatttagttgtacgaacgtaaagtacgttttacggttacggtttacgagtcgtaatacgtaagttggttaagggtaagttacggggttacggtaccgtcgaaccgtacccggttcgggggaacccgaaggggtaaccctacggtcggttcccgtacccgttcctcccttcgacgtcccccgtaccgaacccggtaaccgggtccccctaacggtttccccgggttacccctttccccccggtagggcccccgttacccccgttacccggtacccgaaccggtaccgggtccccttaaccccggg

SEQ ID NO: 43753 - DNA, 554 bp, Homo sapiens
  misc_feature: GYAE6OF02F2IDS.31.14.B03.1.454.CMB.1.raw
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactccgtgaagggccgattcaccatctccagacgacccttccaaccataccgctgtatcctaccaaatgaacatggtnacagttgaagacacggcaacttattattgtgacgaaagtntttcggttggttcgagcaatcaatgtggatagggtgctcgacaccgtgggccagggacncgtgtcacgtctctcncgcctccacacgggccctagtcccggtccttcccccgtggccctaccccgtcctacccaacgaccgcctacccgg

SEQ ID NO: 43754 - DNA, 918 bp, Homo sapiens
  misc_feature: GYAE6OF02IUEK5.31.14.B03.1.454.CMB.1.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
tcagcagtagacgtcacgaccggtgctcgatttagtgtgagtagtttgggctgagtcgtggggttttcctcgttgctcttttaagacggtgtccagtgtctaggtgctacctggtggaatctggggaggcgtggtccggcctgggggtccctgagacctntcctggtcgccatgtctgcgtctgattcgatctagngcatgtggcagtcgctacgtggggtccgccgagggccccgaggccgaaagggtacctggggtacggttgggggtacgacgtaagttttacaaccgtaattttggaagttaggtaagtaaaacgtttaaaaaaacgtttttccggacctaacggtacccgttaccggtaaggtaaacggggcccttaaagtttcccgaacccgttacggttccgtacccggaacggtaaccgtaacccccgttacccgaaccgtaacggtaaccggtcgtttacgtaactacccttaacgtaaacgttacgtaaacacgtttacgggtaacgaacgttaggttacggaaaacgtaaccggtaacggtaacctttaaacgtttagtttacggtttaacggtacggaacggttaaacggtacggtttcgggttacggttaccggaagtacgtaaacgttcgtaaacggtcggttaagggtaaacggttaagggggtccgttaccgtaacccggtaaccgtaacccggggtgggtaaacccggaacggggtaaaacctcggggttacggtaccgaacccggtttaccgcccgttaacggacccgtaccccgtttaccgaaacccggttaacggggtcccttaccgggttacccgggtttaccccttaccccggtacccggtacccttaaccccgttaccccgtaaccggaaccgttacccggaccctttacccggg

SEQ ID NO: 43755 - DNA, 603 bp, Homo sapiens
  misc_feature: GYAE6OF02GXHYY.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaatttgatggagaataaaaaattttcgcagactccgtagaagggccattcaccatctccagacgacccttccaaccatacgctgtatcctaccaaatgaaacagtggtanacagttagaaagacaacggctaaacttattattgtagacgtaaagtattcggtttaggtacgatacatactaaatggtaggaacgttaggggtagccgtacgacaccggtgggaccgaaggggaacctacgtggtaccaccgttctccacacgccctaccgaaccgaacggccctaattcccggtcccttcccccgtaggtacccaccccttcccgtaccgaacggtcgacctacccgg

SEQ ID NO: 43756 - DNA, 546 bp, Homo sapiens
  misc_feature: GYAE6OF02GG5YO.31.14.B03.1.454.CMB.1.raw
  modified_base (257)..(257): a, c, t, g, unknown or other
  misc_feature (257)..(257): n is a, c, g, or t
  modified_base (401)..(401): a, c, t, g, unknown or other
  misc_feature (401)..(401): n is a, c, g, or t
  modified_base (459)..(459): a, c, t, g, unknown or other
  misc_feature (459)..(459): n is a, c, g, or t
  modified_base (478)..(478): a, c, t, g, unknown or other
  misc_feature (478)..(478): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggactgggagtggggtggctatttanactaatttgatggagaataaaaaattttacgcagactccgtgaagggcattcacatctcagacgacccttccaaccatacgctgtatctcaaatgaacatggtgacagttgaagacacggcaacttattattgtgacgtaaagntttcgttggttcgagctatcaatgtggtatagggtgctcgacacgtgggccagggacncgtggtcaccgtctcctancgcctccacgacggcccagttccggtccttccccgtgcccaccccgtcctaccaagcgacctacccgg

SEQ ID NO: 43757 - DNA, 614 bp, Homo sapiens
  misc_feature: GYAE6OF02JHAIJ.31.14.B03.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcactgggtccnccaggccccaggcaagggctggagtgggtgcatttanacattgatggagaataaaaattttacgacagactcgtgaagggccgattcaccatctcctacgagtacccctaccaaccataccgctagtactcctaccaaactgaacatgtagactagttgaagacacggactaacttattattgtagacgtaaagtntttcgttggttcgagctatacaatgtaggattagggtcggtacgtcgaccgtacggtacggggccgtaacgggacgtacgtcggtaccgtaccgttctcccgtacacgtccctacccgaccgacgggtcccctacgttccggtacccttacccccgtgtaccccgtaccccgtcccttacccgaacggtaccgcctaaccccgg

SEQ ID NO: 43758 - DNA, 770 bp, Homo sapiens
  misc_feature: GYAE6OF02GNTPN.31.14.B03.1.454.CMB.1.raw
  modified_base (491)..(491): a, c, t, g, unknown or other
  misc_feature (491)..(491): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaaggggctgggagtggggtggctagtttatacaattttgatgggaagaattaaaaaaattttacgacagtacctcccggtaggaacggggcccgtatttaccaccctaatccttacccgaaggtaccgtaacccccttaccaaaccctaataaccgccttagttaacttaccgtaccaaaattcgaaacctagttagggtgaacctagtttacggaaacgacgaacgggtacaaacctttaattagtttgtagtacgaaaagtntttacggtttagggttacgacgtactaactcgtaaacgttggtacgggtaagttaacgggggtggtaccgtacgggaacccgtaacccgggttgggggacccgaagggggtaacctaccggttcgggtacccgtaccgtttcctacccgtacgtaccgtcccttacccgaacccgaaccggggtccccctagttccccgggtacccttttcccccccggagggtcccctaacccccggttccccgttaacccgaaccggtaccgtccccgtaaccccgg

SEQ ID NO: 43759 - DNA, 791 bp, Homo sapiens
  misc_feature: GYAE6OF02G4NIH.31.14.B03.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccacggccccaggccaagggactgggagtgggtgctatttanactaatttgatggaagtaattaaaaaattttcgacagtactccgtagaacggccgtattcacatctaccagacgacccttaccaaccagtaccgctcgtactcctaccaaagttcgaaactagttaggtgaacttaggttagaaacgaaccgtaacgggtaccttaaacgtttatttaagtttcggtagtaacggtaaagttacgttttaccggtttagggtttaccgaaggtacttaaagttacgtaaacgttgggtaagggtaacggtttagggggtcggtaaccgttccggaaccgttaccgggtagggggtacccgtaaagggggaaccctttaaccgggttcggttaacccgtacccggttccgttcccctaacggtaccgtaccccttacccggaacccggtaaaccggggtccccctaacggttcccccgggtttacccctttacccccccggtcgggtaacccccttaccccccggttaccccgtaaccccggtaaaccggtcccggtaccccgttaaccccccgggg

SEQ ID NO: 43760 - DNA, 658 bp, Homo sapiens
  misc_feature: GYAE6OF02HSNJ7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccgccacgggcccccagggcaaggggactgggaggtggggtggctatttataactaatttgagtttttggaagtaattaaaaattttacgacagactccgtagagggccgtattcaccactctccagacgaccccttaccaaccactacgctagtactactaccaaatagaacagtaggtagtactagtagaacgacgacgactaacttattattgtagacgaagtagtttacggtttggtcgagacatactaagtagtaggtaggtagggtgggtcgtcgacgtaccggtacgggacggacgggacgacgtcggtccgtaccgttcctcctacgtaccgccgtacccgaaccgaaccgggtacccgtaccgtcccggttcccgtttcccccgtacccggtaccctaccccttacccgtacccgtaacgaccgtaccctacccgg

SEQ ID NO: 43761 - DNA, 623 bp, Homo sapiens
  misc_feature: GYAE6OF02GAHC8.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactgggagtgggtggctatttatactaatttgatggagaattaaaaaatttcgacagactccgtaggaaggccgattcaccatctcagacgacccttaccaaccatacgctgtatctaccaaatgaacatggtgactagttgaaagacgacgcaaactttattattgtagacgtaaagtatttcggttggtttacgagtcatactaagtggtggaagttagggtcggctaccgactacccggtggggaccgaacgggactacgtcggtccaccgttcctcctcgacgtccctacccgaaccgaacgggtcccacggttcccggtcccgtttacccccgtcggaccccttacccccgtacccgtacccaacggtaccgaccctaaccccgg

SEQ ID NO: 43762 - DNA, 587 bp, Homo sapiens
  misc_feature: GYAE6OF02HFWWD.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (491)..(491): a, c, t, g, unknown or other
  misc_feature (491)..(491): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanactaatttgatggaagtaattaaaaaattttacgacaagactccgtgaacgggccgattcaccatctcagacgacccttaccaacatacgctcgtatcctaccaaatacgaacatggtagaacgtagttagaacgaacgaacggactaacttattagttgtacgacgaaagtcgtttcgttggttcgagctatacaatggtaggagtagggtgcgtacacgacggtgggaccgaaggacncgtcggtaccacgtctcctcacgcctaccaacgacggccctacgtccggtcccttccccgtcgcctacccgtcctaccgaacgacgaccctacccg

SEQ ID NO: 43763 - DNA, 600 bp, Homo sapiens
  misc_feature: GYAE6OF02FP8VK.31.14.B03.1.454.CMB.1.raw
  modified_base (252)..(252): a, c, t, g, unknown or other
  misc_feature (252)..(252): n is a, c, g, or t
  modified_base (480)..(480): a, c, t, g, unknown or other
  misc_feature (480)..(480): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggcatttanacatttgatggagaataaaaattttacgacagactccgtgaagggccgattcaccatctccagacgacccttccaaccatacgctgtatcctacaaatgaacatggtgactagttagaagacacggactaactttattattgtagacgtaaagtatttcggttggttcgagtcatacaatggtaggtagtaggggtgccgtcgactaccggtggggaccgagggaacncgtcggtaccaccgtctcctcgacgtccctaccgaacccgacgggtcccctacgttcccggtcccctttcccccgtcggaccctacccccgttcctaccccgaggtaccgcccgtacccg

SEQ ID NO: 43764 - DNA, 559 bp, Homo sapiens
  misc_feature: GYAE6OF02GWSG2.31.14.B03.1.454.CMB.1.raw
  modified_base (416)..(416): a, c, t, g, unknown or other
  misc_feature (416)..(416): n is a, c, g, or t
  modified_base (495)..(495): a, c, t, g, unknown or other
  misc_feature (495)..(495): n is a, c, g, or t
  modified_base (531)..(531): a, c, t, g, unknown or other
  misc_feature (531)..(531): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccacggcccccaggcaagggactgggagtgggtggcatttatactaatttgatggagaataaaaaattttacgcagactccgtgaagggccgattcaccatctaccagacgacccttaccaaccatacgctgtatcctaccaaatcgaacatggtgaactagttagaagacacggactaacttattattgtgacgaaagtntttcgtttggttcgagcatcaatgtaggagtagggtgctcgacaccgtgggccaagggacacgtggtacaccgtctccncacgcccaccacgacggcctagtccgtcctccccgngccctaccctcctaccganacnctaccg

SEQ ID NO: 43765 - DNA, 641 bp, Homo sapiens
  misc_feature: GYAE6OF02G3Z27.31.14.B03.1.454.CMB.1.raw
  modified_base (256)..(256): a, c, t, g, unknown or other
  misc_feature (256)..(256): n is a, c, g, or t
  modified_base (402)..(402): a, c, t, g, unknown or other
  misc_feature (402)..(402): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggctgggagtgggtggctatttanactaatttgagtggataataaaaaattttacgacagactccggtgaacgggccgattcaccatcctccgagacgacccttccaaccatacgctgtatctaccaaatgaacatggtgactagttagaagacacgtactaacttattnttagtagtacgtaaagtatttcggttaggttcgagtcaattacgtaagtggtaggtaagttaggggtcgtcgtaccggtaccacccggttggggacccgaaggggtaacctacgttcggtacccgtacccgttctcccgtacgaccgtccctacccgaccgaaccgggtccccagttcccggttacccttcccccgtcggtacccctacccgtcccacccgaaggtaccgcctacccgg

SEQ ID NO: 43766 - DNA, 569 bp, Homo sapiens
  misc_feature: GYAE6OF02F47AD.31.14.B03.1.454.CMB.1.raw
  modified_base (510)..(510): a, c, t, g, unknown or other
  misc_feature (510)..(510): n is a, c, g, or t
  modified_base (552)..(552): a, c, t, g, unknown or other
  misc_feature (552)..(552): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaatttgatggagaattaaaaattttacgcagactccgtgaacgggccgtattcaccatctaccagacgacccttccaaccatacgctgtactctaccaaatcgaactatggtgaacgtagttagaaacgacgacggactaactttattattcgtagacgaaagtcgttacgttggttcgagctatcgtaatggtaggtagtagggtcgctcgaccacggtggggacagggacacgtcggactccgtctcctcncgccctcacgacggccacgtccgtcctccccgtgccctaccncctacagaccnctaccg

SEQ ID NO: 43767 - DNA, 744 bp, Homo sapiens
  misc_feature: GYAE6OF02GERD3.31.14.B03.1.454.CMB.1.raw
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtcccnccgacggccccaggcgaagggctgggagtgggtgctagtttanactatttgagtggaagtaaattaaaaaagttttcgacaagtacctccggtaggaacgggccgtattaccgacctatcctaccgaaggaccgtaccccttaccaaacctagtaccgcttagttactcctaaccaaagtcgaaacagttggtacgaactaggttaagaacgacgacggtactaaactttaattacgttggtacgaacgtaaaagtgtttacggttaggtttacgagtactaacgtacgtaagttcggtaggtaaggttaggggtcgccgtaccggaacctaccgggtacggggaccgtaaggggaacctacggttcgggtacctacccgttcttacccgtacgaccgtcccctacccgaacccggtaaccgggtcccctaacggtttccccgggttaccccctttacccccggcggtacccccttacccccgttaccccgtaacccgtaacggtacccgtacccgttaaccccggg

SEQ ID NO: 43768 - DNA, 732 bp, Homo sapiens
  misc_feature: GYAE6OF02H57YI.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgctatttatacaatttgatggagtaataaaaatttcgacagactcgtgaagggccgattcaccatctaccagacgacccttccaaaccatacgctagtactctacctaaatacgaactagtggtagacaagttagaaagtacgaacgtactaaactttagttatttggtacgacgtaaagtacttttacggtttacgggttacgaaggtactaacgttacaaagttggttacgggtaagttaacgggggttcgggaccttacggaaccgtaacccggttcggggggaacccgaaaggggtaacctaccggttaccgggttacccgtaaacccgttcccgtaccctacccgtaaccgtacccccccgaaccggtaaacccgggtaccccgtaccggttaccccggtttacccgttccccccgtttaccgggacccctaacccccgttcccgtacccgtaaaccggaccgtaccccgacccgttacccggg

SEQ ID NO: 43769 - DNA, 563 bp, Homo sapiens
  misc_feature: GYAE6OF02JGLMT.31.14.B03.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (354)..(354): a, c, t, g, unknown or other
  misc_feature (354)..(354): n is a, c, g, or t
  modified_base (435)..(435): a, c, t, g, unknown or other
  misc_feature (435)..(435): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctgggggtccctgagactctcctgtgccatgtctgcgtctgaattcatcctcaggcactatggcatgcactgggtccnccaggccccaggcaagggactggagtgggtgcatttanacaatttgatggagataaaaattttacgcagactccgtgaagggccgattcaccatctccagagacccttccaaccatacgctgtatctccaaatgaacatggtnacagttgaagacacggcaacttattattgtgacgaaagtatttcgttggttcgagcatcaatgtggatagggtgctcgacnccgtggggccagggacacgtggtcaccgtctcctcacgccctaccaccgaacgggtccccaagttccgggtacccttccccccgtagggccctaccccgttccctacccgaacgacgccctaaccccg

SEQ ID NO: 43770 - DNA, 581 bp, Homo sapiens
  misc_feature: GYAE6OF02I1F8Z.31.14.B03.1.454.CMB.1.raw
  modified_base (542)..(542): a, c, t, g, unknown or other
  misc_feature (542)..(542): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagaataaaaattttacgcagactccgtgaagggccattcacatctccagacgacccttccaaccatacgctgtatcctaccaaatgaacagtggtagacagttgaagacacggactaaacttattattgtgacgtaaagactttcggttggttcgagcatacaatgtcggaagtagggtcggctcgacaccgtggggccaagggactacgtggtaccaccggtccttccgtcacgcccgtaccacgaaccgggcccagttccggtcctttcccccgnggtacccaccccgttccgtaccaacggaccgcctacccg

SEQ ID NO: 43771 - DNA, 961 bp, Homo sapiens
  misc_feature: GYAE6OF02FSI0Y.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatctgggggagcgtggtccggcctgggggtccctgagactctcctgtgccatgtctgcgtctgaattcatcctcaggcactagtggcagtcgactacggtcgggtcccgaccgaccggaccccgaggaccggaaacgggtcgtagggagggttggggtcgtaactttaagtttaactaacgttaagtttaggtaggtaaggtaaaagttaaaaaagttttaaaaaacgttttaccgaccgtaaacgtaacccggttaccgggtaaagggaaccggggtaccgttaacttaacccgaaaccgttacttaccccgtaaccggtaacggtaaccccggttaacccccttaacccaaaaccgttaacgttacccggtacgtttaacggttaaccttaaccctaaaccgtaaaagtacgtaaaacgttcgggttacggtacgtaaacggttaagggttaaacggaaacgtaaccggtaaccgttaactttaaacgttttaagttttacgggttaacggtacgggtaaaacgttaaaacggttttcgttttaccggggtttaaggtttaccggaaacttacgttaaacctaaggttaacggttagggttaacggggttaaggtacggggtcgtaccctaacgggtaacccggttacggggtaaccggggtaaccgaaaggttacccgtaacggttccggtaacccgttaccgttcccgtaaacccgtacgacccggtacccgtaacccggaaccggtaacccgggtccctaaccgggtttccccgtaccccgttaccccggtaccgaccccgttaccccttaccgaacggaccggttaccgaccccgttacccggg

SEQ ID NO: 43772 - DNA, 791 bp, Homo sapiens
  misc_feature: GYAE6OF02HJQNZ.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggctgggggtccctgagactctcctgtgccatgtctgcgtctgaattcatcctcaggcactatggcatgcacgtgggtccgccacggccccaggcaagggactgggagtgggtggctatttanactaatttgatggaagtaattaaaaaagtttcgacagaccgtccgtaggaacgggccgtaattccaacctattcctaccgaacggacctaaccccttaccgaaacctactaccgtcgttagtaacctactacccaaaagttacgaacgtagtacggtagtaacgtagttacgaacggactaacggtaacttaaactttagttagtttacggtacgaacgtaaagtttacgtttacggttttacgggttaccgagtactaacgttaccgtaaagttgggtagggtaaacggttaggggttcgtaccgtaacgtaacccgtaccgggttacggggaacccgtaaagggtaaccctacggttacgggtacccttaaccgtcccgttacccgacgtaccggtcccccgtacccgaacccgggtaaccgggtccccttaaccgttccccgggtttacccccgtttaaccccccggtcggtaacccccctacccccgttacccggttaaccccgaaacggtcccggacccgttaacccccggg

SEQ ID NO: 43773 - DNA, 608 bp, Homo sapiens
  misc_feature: GYAE6OF02GH7OG.31.14.B03.1.454.CMB.1.raw
  modified_base (257)..(257): a, c, t, g, unknown or other
  misc_feature (257)..(257): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggccaaggggactgggagtgggtggctatttanactaatttgatggaagaattaaaaattttacgacagactccgtggaaggccgattcaccatctccagacgacccttaccaaaccataccgctagtatcctaccaaatgaactatggtgactagttagaagacacggactaactttattagtagtgacgaaagtntttcgttggttacgatactatcaagtgtaggtagtagggtgctacgacgacggtcgggaccgagggaacctcgttacgggtccacccggttctccctcgaccgccctaccaccgtaccgggccctacgttcccggtccctttcccccgtagcccctaccctccctaccgaacgtccgaccgtacccg

SEQ ID NO: 43774 - DNA, 529 bp, Homo sapiens
  misc_feature: GYAE6OF02FXG9M.31.14.B03.1.454.CMB.1.raw
  modified_base (251)..(251): a, c, t, g, unknown or other
  misc_feature (251)..(251): n is a, c, g, or t
  modified_base (398)..(398): a, c, t, g, unknown or other
  misc_feature (398)..(398): n is a, c, g, or t
  modified_base (504)..(504): a, c, t, g, unknown or other
  misc_feature (504)..(504): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggtgtggtccggcctggggggtccctgagactctcctgtgccatgtctgcgtctgaattcatcctcaggcactatggcatgcactgggtccgccaggccccaggcaagggctggagtgggtgcatttanacaatttgatggagataaaaaattttacgcagactccgtgaagggccgattcaccatctccagagaccccttccaaccatacgctgtatctccaaatgaacatggtgacagttgaagacacggacaacttattattgtgtgaaagtnttcgttggttcgagcatcaatgtggatgggtgctcgacaccgtggggccagggacacgtggtcaccgtctcctcagccctcaccaagggcccatccgtcttccccnggccaccctcctcaacgcgctaccg

SEQ ID NO: 43775 - DNA, 615 bp, Homo sapiens
  misc_feature: GYAE6OF02JJS2L.31.14.B03.1.454.CMB.1.raw
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtcccgccacggccccaggcaagggactgggagtgggtgctatttanactattgataggagtaaattaaaaatttacgacaggactaccggtagaaaggggcccgaagtttccgaccctaatcctacccaagtacgaacccctttccaaacccattaaccgctcgtaactacttccaaaatgaaaccatacggtagaacagttagaaagtacaacggacaaacttattaacttagtagacgtaaagtattacgttaggttacgagtcaatcaatgtaggatagggtgactcgacaccgtagggaccagggacacgtcggtacaccgtctacctcacgcctcaccaacggcccagtccggtccttaccccgtagcccacccgtacctaccaacgtacacctaccg

SEQ ID NO: 43776 - DNA, 614 bp, Homo sapiens
  misc_feature: GYAE6OF02HZH8V.31.14.B03.1.454.CMB.1.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggctgagctgggtttttcctcgttgctctttttaagaggtgtccagtgtcaggtgcacctggtggaatctgggggaggcgtggtccggcctggggggtccctgagactctcctgtgccatgtctgcgtctgaattcatcctcaggcactatggcatgcactggggtcccgccaggccccaggcaaagggctggaggtgggtgctatttanactaatttgatggaanaattaaaaaattttcgcagactccgtgaaggcgattcaccatcnccagacgacccttaccaaccataccgctgtactcctacaaatgaaacagtaggtntactagttagaagaaccgacgactaacttatttatgtgaacgaagtagtttacggttggttacgagctatcaagtgtaggtagtagggtgctacgactccggtgggaccgaagggactacgtggacccgtaccgtcctcctacncgcccctacacccgaacgggcccctacggttcccggttacccttcccccgtggtcccctaccccgttacccaccctaacggaccgcccgtaccccgg

SEQ ID NO: 43777 - DNA, 587 bp, Homo sapiens
  misc_feature: GYAE6OF02ISWS3.31.14.B03.1.454.CMB.1.raw
  modified_base (558)..(558): a, c, t, g, unknown or other
  misc_feature (558)..(558): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgcaggccccaggcaagggactgggagtgggtgcatttatacaatttgatggagaattaaaaaattttacgacagactccgtagaagggccgattcaccatctaccagacgaccccttaccaaccataccgctagtatcctaccaaatgaaacagtgtagaactagttgaaacgacaacggactaaactttaatttaatttagtacgacgtaaaagtatttcggttagggttacgagtactatacaagtgtaggtagtagggtgctcgacaccggtgggccaagggacacgtggtccaccgtctccgtcacgtcctaccacgacggcccagtccggtacctcccgngcctaccctcctaccgaacgcgcctaccg

SEQ ID NO: 43778 - DNA, 770 bp, Homo sapiens
  misc_feature: GYAE6OF02H3N29.31.14.B03.1.454.CMB.1.raw
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggccgtggggggtccctgagactctcctgtgccatgtctgcgtctgaattcatcctcaggcactatggcatcgcacgtcgggcccgccgacggccccaggccgaagggacgtgggaggtggggtggctatttacgtactaagtttggataggaagtaaaattaaaaaagttttcgacaagtacgtaccggtaggtaacgggtcctattaccacctattccgtaccagtaccgtacccccttaccgaaacctataaccgtactacgtactacctaccaaatacgaactagtcggtagactagttagaacgtacaacgtactaatttagttagtttgtacgaacgtaagttacgtttacggtttaggtcgacgactatacgtaagttggtaggtagtagggtcgccgtacgacgtaccggtaggggacccgtaaacgggactacggttaccgggtaccgtaaccccgtttccgtacccgtaccgtacccggtcccctaccccgtaaacccggtaaccggggtccccttaaccggttaccccggggttccccctttaccccccggtaccgggtaccccccgtttaacccccgttaccccgtaaacccggtaacggtaccccggtacccgttaacccccgggg

SEQ ID NO: 43779 - DNA, 562 bp, Homo sapiens
  misc_feature: GYAE6OF02G9JCI.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaatttgatggagaattaaaaaattttcgcagactccgtgaaggccattcaccatctccagagtacccttaccaaccatacgctgtactcctaccaaatgaacatggtgacagttagaagacacggactaacttattattgtagacgaaagtgtttacgttggttcgagctatcaatggtaggtagtagggtgctcgactccgtggggaccagggaacaccgtgacctcgtcctcacgcctccaccgacggaccgccgtcgttccgtcccctccgccgtaccctccctccacgacgcacccgtcgg

SEQ ID NO: 43780 - DNA, 836 bp, Homo sapiens
  misc_feature: GYAE6OF02GCSS3.31.14.B03.1.454.CMB.1.raw
  modified_base (188)..(188): a, c, t, g, unknown or other
  misc_feature (188)..(188): n is a, c, g, or t
tcagcagtagacgtcacgaccggtgctcgatttagtgtgagtagtttgggctgagctgggtttcctcgttgctctttaagaggtgtccagtgtcaggtgcacctggtggaatctgggggaggcggtggtccggccgtgggggtcccgtgagactctcctgtgccatgtctgcgtctgaattcatcctnaggcactatggcatgcacgtgggtccaccgacggccccagggccaagggggtactggggaggttggggtggctaattttacgtacaattttggattcgggaataagttaaaaaaattttccgacgaagtacgtccggttagggaaacgggtccggtaactttaccaacccgtatcccgtaccgagtaacggtaccccctttaccaaacccaattaccgaccgttagtaactccttaccaaaatacgtaaacacgttgggataacctaagttgaaacgaacacggacttaaacttatttaacgtggtacgtacgtaaaaacggtcgtttcgttacgggtttaccgaacgtacgtaacggttaaccaagtttagggttagggtaaagttacgggggttacggaccgtttacgaacccggtacccgggtcgggggttaaacccgaacggggtaaaccgtaccgttcggggtaaccctacccgggttacctcccgttaaccgaacggtacccccgttaccgaaaccccgtaaacgggggttcccccaacggtttccccggggttacccctttacccccccgtacgggggtacccccttaacccccgttacccccgttaaccgtaacggacccggtaccccttaaaccccggg

SEQ ID NO: 43781 - DNA, 656 bp, Homo sapiens
  misc_feature: GYAE6OF02I5V38.31.14.B03.1.454.CMB.1.raw
  modified_base (362)..(362): a, c, t, g, unknown or other
  misc_feature (362)..(362): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctgagactctcctgtgccatgtctgcgtctgaattcatcctcaggcactatggcatgcacgtgggtccgccaggccccaggcaagggactgggagtgggtggctatttatacaatttgatggagaataaaaatttacgcagactcgtgaaggcgattcaccatctccagacgaccttccaaccatacgctgtactctaccaaatgaacagtggtanactagttgaagacaacggctaaacttattatttagtgacggtaaagtagtttacgttcgggttacgaggtcaagtactaaagtgtagggaattagggggttcggacttcgaccgtaaccgggtcggggcccggaagggaaaccgtcgtcgggttaccacccggttcctacccgtcgacgacccgtacccaacccggaacggggaccccctagttccccgggttacccctttccccccggtgtcccccgaaccccgttcccctacccggaaacggtccgtacccgtaacccccgg

SEQ ID NO: 43782 - DNA, 750 bp, Homo sapiens
  misc_feature: GYAE6OF02I08HJ.31.14.B03.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgcatttanacaatttgatggagataaaaattttacgcagactcgtagaagggccaattcaccatctccagacgacccttccaaccatacgctgtactctaccaaatcgaaacacgtggtagactaggttagaaacgacacggactaacgtttaattatttgtagacggtaaaagtactttacggtttcgggtttacgagtaccgtagttaccaaagttcggttagggaagttaggggggttacggtaccgttaccggtacccgtacccggttacgggggacccgtaaacgggggtaacctaaccggttcgggttaacccgacccggttttccgttaccccgttaccgtaaccgggtaccccgttaccccgaaacccggtaaccgggggtaccccctaacggttaccccgggtttccccgtttaccccccccggtacgggtaccccctaccccccggtttaccccttaacccccggtaaacggtacccggaccccgttaacccccggg

SEQ ID NO: 43783 - DNA, 692 bp, Homo sapiens
  misc_feature: GYAE6OF02ILW4D.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcactcgggtccgccaggccccaggacgaagggactgggagtggggtgctatttatactaatttgataggaagtaaattaaaaaattttacgacaagactccggtagaacgggtcgattccacactcctaccagacgtaccctaccaacatacgctgtaatcctacaaatgaaactagtcggtagaactaggttacgaaacgacgaacggtactaaactttacgttaatttggtacggacgtaaaacgtactttacggtttaggtcgaagtactatacgaagttgtaggtacgttaggggtacgcgtacgaccggtaccgtaggggacccgaagggaaccctaggtcggtacctaccgtaccgtccgtacgacccgtaccgtacccgaaccggtaaccgggccccttaaccggtccccggttaaccccgttcccccgtccggtaccctacccctaccgttaacccgacgtacccgcccgtaacccggg

SEQ ID NO: 43784 - DNA, 1006 bp, Homo sapiens
  misc_feature: GYAE6OF02JPSFV.31.14.B03.1.454.CMB.1.raw
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgctacgtgggtcccgccacggccccaggccgtaagggacttgggagtggggtggactatttanactaattttgagtaggagtaattaaaaaagttttacggactaagaaccgttcccggttaggaaacggggacccggtaacttaccaacccgattaccttaccgaaggaaccgtaaccccctttaccccgaaaccctaacgttaaccgtccttacggttacttacctaaccctaaagtacgaaacctaagttagggtacgaacgttagtttaacgggaaacgaacccgtaacggggtaaccttaaaacgttttaaacgttttaacgttacgggttaacgggtaaccggtaaaaacgggtttacgtttttaccgggttttagggtttaacccgggtaacgtaacgtaaacgttaacgttaaacgtttaggggtaacgggtttaagggtttaacggggggttacgggtacccgtttaacccgggtaacccggttaaccccggggttagggggggaacccggttaaacgggggtaaaacccgttacccgggttaccggggttaaccccgtaacccgggtttaccccgttaaccccggttacccgtaccgggttaccccccctacccggtaaaccccgggtaacccccgggggtaacccccgttaaacgggtttcccccgggggttttacccccccgtttaccccccccgggttaaccgggtaaccccccgtttaacccccccggtttaaccccggttaacccccggtaaaccgggtaccccggttaccccggttaaccccccgggg

SEQ ID NO: 43785 - DNA, 544 bp, Homo sapiens
  misc_feature: GYAE6OF02FVTC4.31.14.B03.1.454.CMB.1.raw
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
  modified_base (471)..(471): a, c, t, g, unknown or other
  misc_feature (471)..(471): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaatttacgcagactccgtgaagggccgattcaccatctccagacgacccttccaaccatacgctgtatctaccaaatgaacatggtgacagttgaagacacggcaacttattattgtgacgaaagtntttcgtggttcgagcatcaatgtggatagggtgctcgacncgtgggccagggacacgtggtcaccgtctccncacgcctccaccgacggcccagtcccggtccttcccccgtgcccacccgtccctaccgaacgacgcctacccg

SEQ ID NO: 43786 - DNA, 687 bp, Homo sapiens
  misc_feature: GYAE6OF02GDTL0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtgcatttatacatttgatggagataaaaatttcgacagactccgtgaagggccgattcaccatctccagacgtacccttccaaccatacgctgtactctaccaaatgaacatggtagactagttagaagtacacgactaactttattattgtgacgtaaagtacttcgttaggttaccgagtacctatacgtaactggtagggtagtacggggtggtaccgttccggaacctacccgggttacgggggacccgaagggggtaaacctacgttacgggttacccgtaaccgtttccttacccgtacgaccgtccccgttacccgaaccccggaacggggtaccccctacggtttccccgggttaccccctttccccccggtaccgggtaccccttacccccgttaccccgttacccgtaaaccggtccgaccccgttaaccccggg

SEQ ID NO: 43787 - DNA, 566 bp, Homo sapiens
  misc_feature: GYAE6OF02GQSNF.31.14.B03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (358)..(358): a, c, t, g, unknown or other
  misc_feature (358)..(358): n is a, c, g, or t
  modified_base (462)..(462): a, c, t, g, unknown or other
  misc_feature (462)..(462): n is a, c, g, or t
  modified_base (525)..(525): a, c, t, g, unknown or other
  misc_feature (525)..(525): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtggcatttanacaatttgatggagataaaaaattttacgcagactccgtgaagggccgattcaccatctccagagacccttccaaccatacgctgtatctccaaatgaacatggtnacagttgaagacacggacaaacttattaacttgtgacgaaagatttcgttggttcgagcatcaatgtaggatagggtgcgtgactaccgtggggccagggaacncgtggtcaccgtctcctcgacgcctccaccaacggggcccaagttccgggtcctttcccccgnggccctaccccgttccctacccgaacgaccgcctaacccgg

SEQ ID NO: 43788 - DNA, 553 bp, Homo sapiens
  misc_feature: GYAE6OF02IHZ4X.31.14.B03.1.454.CMB.1.raw
  modified_base (477)..(477): a, c, t, g, unknown or other
  misc_feature (477)..(477): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggcaagggctgggagtgggtgcatttatacaatttgatggagataaaaaattttacgcagactccgtgaagggccgattcaccatctccagacgacccttccaaccatacgctgtactctaccaaatgaacatggtgacagttgaaagacacggacaacttattattgtagacgaaagtatttcgttggttacgagtcatctaatggtagagtagggtggctacgacaccgtggggccagggacacgtggtacnccgtctcctcacgcctccacgacggcccatccggtccttccccgcggccaccctcctaccgaacgcgcctacccgg

SEQ ID NO: 43789 - DNA, 666 bp, Homo sapiens
  misc_feature: GYAE6OF02I3Q52.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
tcagcagtagacgtcacgaccggtgctcgatttagtgtgagtagtttgggctgagcgtgggttttccgtcgttgctctttaagaggtgtccagtgtcaggtgcacctggtggaatcgtgggggaggcgtggtccggccgtggggggtccctgagctctctgtgcatgctgcgtctgaattcatcctnaggcactatggcagtgcacgtcgggccnccacggcccaggccaaggggctgggagtgggtgactatttacatatttgagttggataaattaaaaaactttcgganagtacctaccggtaggaacggacgtaattcaaccntctcaagcgacctacaaccanccgtntactactacacaagtacactagtacgganacgtagtacgaacgaccgagtaacttaattattacgtacgtagaacgtaaagttacgttcggttaggtacgagtacttagtacgtaagttaggtaggtaggtagggtcgtacccggtacgtaccgtaccggggtcgggaccgtaacgggtaacctggttccgtacctaccgttcccgccgtacgtaccgaccctacggaacccggaccggtccctaccggttccgttccccgttcccgccggtacccctaacccgtcccaaccggtacgaccgtacccgtccgg

SEQ ID NO: 43790 - DNA, 667 bp, Homo sapiens
  misc_feature: GYAE6OF02IZEV8.31.14.B03.1.454.CMB.1.raw
  modified_base (284)..(284): a, c, t, g, unknown or other
  misc_feature (284)..(284): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggacttgggacgtagggtggctatttatacatttgatggagaataaaaatttcgnagacctcgtagaagggccgtattcaccatcctccgagacgaccccttaccaaccataccgctcgtatcctacaaatgaacagtggtagacagttagaagacgacgactaacgttattagttaggtacgacgtaaagtactttcgttggttacgagtactacttacaagtggtaggtagttaggggtcggctaccggaccgtaccggtcggggacccgaaggggtaacctacgttcgggtaccacccgggttactaccccgtacgaaccgccctacccgaacccggtaaaccggggtcccctaacgttcccgggttccccttaccccccggtcggacccctacccccgttacccgacccgtaaaccgtacgcccctaaccccgg

SEQ ID NO: 43791 - DNA, 654 bp, Homo sapiens
  misc_feature: GYAE6OF02JWM7H.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactcgggtccgccaggccccaggcaagggactggaggtgggtggcatttatacaatttgagtggaagtaattaaaaaagttttacgacagactccgtggaacgggccgtattcgaaccatcctccgagacgtaaccccttccaacctactacgctgtactcctaccaaatcgaacatggtcgactaggttagaaacgacacggactaacgtttattattgtagacgtaaagtagttcgttaggtcgagtctatacagttgtaggagttagggtcgtctacgacaccgggttcggggaccgtaagggtaaccacggttacggtcccgtaccgtccgtacccgtcgacggtaccctaccgaaccggaacgggcccctaacgttccgggtcccctttccccgacggtaccctacccccgttaccctaccgaacggtacccgtaccctacccgg

SEQ ID NO: 43792 - DNA, 757 bp, Homo sapiens
  misc_feature: GYAE6OF02JDWTY.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggacctgggagtgggtggcagttttanacaatttgatggagattaaaaatttacgacagactccgtagaagggccgattcacatctccagacgacccttacaaccctaataccgcttagtacttcctaccaaagttcggaaactactgggtacgaactaggttggaaacgaaccgaaccggtactaaaccttaattttagtttagttacggacgtaaaagtacgtttacggtttagggtttacggtaaggtacctacttaaccgaaagtttaggttagggtaagttaacgggggtgggtacccgttacgggtaacccgtacccgtacggggggtcccgaacggggtaaaccgtaccgttagggttacccgtaacccggtttcccttacccgtccgtaaccgcccgttcccgaaacccgaaccgggggccccctaacggttcccgggttaacccctttccccccggttcggtacccctacccccgttaccctaaccccggaaccggtaccggccccgttaacccccggg

SEQ ID NO: 43793 - DNA, 748 bp, Homo sapiens
  misc_feature: GYAE6OF02IA1BC.31.14.B03.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggccgtggggggtccctgagactctcctgtgccatgtctgcgtctgaattcatcctcaggccactagtggacatgcacgtcggggtcccnccgacggccccagggcaaggggtactgggagtggggtggactatttagtactaatttggagtaggaagtaaattaaaaaattttacgacaacgacgtaccggtaggaacgggccgtaattacaccactctaccaaggtacctacccttaccaaccataccgctagtacttaccaactaaatacgaaactagtcggatacgtagtagaacgtacgaacggtactaaacttattacgttagtagtacgtaaagtagtttacgttggtacgagtcaatacgtagtggtagtaaggtagggtgtacgtacggtacgaccgggtcggggaacccgtaagggaacctaccggtaggttaccccgtaaccgggttcccttacccgtacccgtacgtaccccgtacccgaacccgggtaaccggtaccccggtaacggttccccggtttaccccgtttaccccccggttaccgggtacccctacccccggttacccgttaacccaaacggttacccggacccgttaacccccggg

SEQ ID NO: 43794 - DNA, 581 bp, Homo sapiens
  misc_feature: GYAE6OF02FUP2M.31.14.B03.1.454.CMB.1.raw
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaattttacgcagactccgtgaagggccgattcacatctccagagacccttccaaccatacgctgtactctccaaattgaacatggtnacagttgaagacacggcaaactttattattgtgacgtaaagtattcgttggtcgagctatcaattgtaggatagggtgctcgacaccgtggggccaggggaacacgtcgggtcaccgtctcctacacgcccttccacccgaacgggcccctaattcccgggttccctttccccccgtgggcccctaccccttccccgtacccgtaacggacgccctacccgg

SEQ ID NO: 43795 - DNA, 585 bp, Homo sapiens
  misc_feature: GYAE6OF02FNRBI.31.14.B03.1.454.CMB.1.raw
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggccccaggcaagggactggagtgggtggcatttanacaatttgatggagataaaaattttacgcagactccgtgaagggccgattcacatctccaganacccttaccaaccatacgctgtatctaccaaatgaaacatggtgacagttagaagacgacggacaacttatttatgtagtacgaaagtatttcgttgggttacgagactatctaatgtggagtagggtgctcgacaccggtgggccaggggaacncgtcggtacaccgtctcctcgacnccctaccacccgaagggcccctagttcccggtcccttccccccgtacggccctacccccgtccgttacccgacgtaccgtccctaccccgg

SEQ ID NO: 43796 - DNA, 560 bp, Homo sapiens
  misc_feature: GYAE6OF02I8FHC.31.14.B03.1.454.CMB.1.raw
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgctattatacattgatgganaattaaaaatttacnagactcgtggaagggacgtattcaccatctccagacgacccttccaaccatacgctagtactctaccaaattgaacagtggtanactagttagaanacacgactaacttattatgtagacgaaatctttcggttaggtacgagtctatacaagtgtaggataggggtgcctacgacaccgtaggggcaacggacacgtcggccaccgttctcctcacgcctaccaccgaacggcctacgtccgtccctcccgtgcctaccctctaccacgtacgcctaccg

SEQ ID NO: 43797 - DNA, 663 bp, Homo sapiens
  misc_feature: GYAE6OF02FE9SW.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccaggcaagggactggagtgggtggcatttanacatttgatggagtaattaaaaatttacgctagactccgtgacgggccattcaccatctccagacgaccccttacaaccatacnctgtactctaccaaatcgaacngtggtanaaccgtagttagaagacacggactaactttatttatgagtacgtaaagtgtttcgttggtttcgagactattacaagttggttaggagttaggggtcgcctacgcaccggtcggggaccaggggtaactacggttgggtaccctaaccggttcctacccgttcgaccgtaccccttcccgaaaccggaaccgggtccccctaacggttccccgggttttaccctttaccccgtccgtaccgggtacccccttaaaccccccgttaccctaccccgtaacgggtaccctacccccg

SEQ ID NO: 43798 - DNA, 677 bp, Homo sapiens
  misc_feature: GYAE6OF02HM3GK.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtgcatttanacaatttgatggagaattaaaaatttacgacagactcgtagaaggcgtattcactatctccagacgacccttccaacactacgctagtactctaccaaatcgaactagtggtagactagttagaagacacggactaacttattattgtacgacgaaagtagtttacggttggttacgagtactatacgtaagttcggtaggtaagttaggggtcgtaccgtcggaaccgtaccggtcggggacccgaaacggggtaaccacggttacggtacctacccggttcctcccgtaccgaccgtcccgttacccgaacccggtaaccggggtcccctacggttacccgggttaccccgtttaccccccgtacgggtacccctacccccgttacccgtaacccgaacggtaccgtccccttaaccccggg

SEQ ID NO: 43799 - DNA, 799 bp, Homo sapiens
  misc_feature: GYAE6OF02JDXQG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctggggggtccctgagactctcctgtgccatgtctgcgtctgaattcatcctcaggcactatggcatgcacgtcgggtccgccacggccccaggccaagggactgggaggtcgggtaggctaagtttatacctaatttgatggaagtaattaaaaaagttttcgacaagtaccgtccgtaggaacgggtcccgtaatttaccgaaccagttcctacccgaagtaccggtaaccccttaccaaaccgtacgtaccgtcttaggtaactccgtaaccaaatacgaactagttggtacgacgtagttacgaaacgacgtaacggactaaactttactttagttacgtagaacggtaaagttagtttaccgggtttaggttaccgaaggtactaacgttactaaaggttggtaggtaacggttacggggttacggtaccgtacgggaaccgtaccgggttcgggggacccgtaaacgggggtaacctaccgggttacgggttacccgaacccggtttccgtacccgttaccgtaccgtccccgttacccgaaccggtaaacccgggtcccccgtaacggtttccccggttacccgtttacccccccggtagggtacccccttacccccgtacccgttaacccggtaacgtaccggtacccctaacccggg

SEQ ID NO: 43800 - DNA, 636 bp, Homo sapiens
  misc_feature: GYAE6OF02I3S2Z.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttanactaatttgataggagtaataaaaaattttacgacagtactccgtagaagggccgattcacatctccagacgacccttaccaaccatacgctgtatctaccaaatgaactataggtgacagttagaagaacgacggactaacttattattgtagtagaaagtagtttcgttggttacgagtctaatacaagtggttaggaagttaaggggtgtaccgtcgaccgaccggtcgggggaccaacggggtaactaccgttggtacccgacccgttccgtcccttacgaccgccccttacccgaacccgaaccgggtcccaacggttccggttcccttccccgtacggaccctaccccctccgtacccaacgtaccgacctacccgg

SEQ ID NO: 43801 - DNA, 566 bp, Homo sapiens
  misc_feature: GYAE6OF02IDS2E.31.14.B03.1.454.CMB.1.raw
  modified_base (454)..(454): a, c, t, g, unknown or other
  misc_feature (454)..(454): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttatacaatttgatggagataaaaaattttacgcagactcgtgaagggccgattcaccatctccagacgacccttccaaccatacgctgtatctaccaaatgaacatggtgacagttagaagacacgactaacttattatttgtgacgaaagtattcggttggttacgagtcatacaagtgtaggatagggtgctcgacaccgngggaccagggacacgtggctaccgtctcctcacgcctaccgaaccgacggcccacgtcccggtcccttcccccgtggcccacccgtccctacccgaacgtacgcctacccgg

SEQ ID NO: 43802 - DNA, 649 bp, Homo sapiens
  misc_feature: GYAE6OF02HL8RO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggccaagggactggagtgggtgactatttatacaatttgatggagaataaaaattttacgcagactccgtgaacgggccgtattcaccatctccagacgacccttccaacactacgctagtactctaccaaatacgaacagtggtagaacgtagttagaaacgtacgacggactaacttattagtttgtagacgaaaagtatttacggttaggttacgagacctaatacaaagtggtacggtagttaggggtggtaccgtacggacgtaaccggtggggacccgtaagggaaccacgttcggtacctacccgtcttcccgtacgtaccgtccctaccgaacccggaacgggtcccctaggttcccggttcccttacccccgtcggacccctaccccgtcccgtaccaacgaccgaccctacccgg

SEQ ID NO: 43803 - DNA, 586 bp, Homo sapiens
  misc_feature: GYAE6OF02HRR8K.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacaattgatggagataaaaattttacgcagactccgtgaagggccattcaccatctccagagacccttccaaccatacgctgtatctaccaaatgaacatggtgacagttgaaagacaacggacaaacttattatttgtgacgaaagtatttcggttggttcgagcatcaatggtagagtagggtgctcgacaccgtggggaccagggaacacgtggtccaccgttcctctcgacgccctaccaccgaacgggccctacgttacccgggttcccttaccccccgtgggacccctaccccgttcccgtaccccgaaagtaccgaccctaccccgg

SEQ ID NO: 43804 - DNA, 652 bp, Homo sapiens
  misc_feature: GYAE6OF02HFYI5.31.14.B03.1.454.CMB.1.raw
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtcccnccagggccccaggcaagggtctgggagtgggtgctatttanactaatttgatggagaataaaaaattttacgcaagactccgtagaagggccgattcacatctccagacgacccttaccaaccactacgcttgtatctacctaaatcgaacatggtagactagttacgaagacacggctaaattattaattgtagacggaaagtatttacggttggtacgagctatactaaagtggtaggtaaggttaggggtgaccgtacgtaccgaccggttcggggaacccgaaggggaacctacgtggtacctaaccggtccctacccgtcaacgtcccttacccgaccgtaacggggacccctagttcccgggttacccttccccccggtcggaccctacccccgtacccgtacccgaaaggtccgaccctaaccccgg

SEQ ID NO: 43805 - DNA, 669 bp, Homo sapiens
  misc_feature: GYAE6OF02ILJA7.31.14.B03.1.454.CMB.1.raw
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccaggccccaggcaagggactggagtgggtggcattatacaatttgatggagataaaaaaattttacgacagactccgtagaagggccgtattcaccatctcagagacccttccaaccatacgctgtatctccaaatgaaacatggtnacagttgaacgtacaaccgggacaaacttaatttaatttacgtaggtacgaaaacgtaatttccgggtttaggttacggaggtaccaataccaaattcgggtaggtaagttaaggggtgggtccttacgaccgaccggttagggggaccctaagggggaaacaccgttgggtaccctaaaccggttcctaccccgtacgacgccccgttacccaacccggtaaaaccgggcccctaacggtccggttaccccgttccccccgtaggaccctaccccttaccgtccccgaaaggccgacctaaccccgg

SEQ ID NO: 43806 - DNA, 720 bp, Homo sapiens
  misc_feature: GYAE6OF02IX1Z6.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccacggccccaggcaagggactgggaggtgggtggctatttatactaatttgatggaagtaattaaaaaattttacgacaagtactccggtaggaacgggccgtattacacctatcctaccagacgtacccttaccaacctatacgctgtactcctaccaaatacgaactagtggtagacgtagttacggaagaacgacggtactaaacgtttatttagttagtacgtaacggtaaagtgtttacggtttaggggttaccgagtactattactaacgtggtaggtaagtaggggttcgtaccgtaccgacgtaccgggtacggggaccgaacggggtaactaccgtcgggtaccctacccggttccttacccgtcgtaccgtccccgtacccgaacccggaaccgggtccccctaacgttccccgggttccccttacccccggtccggtacccccttaccccgtaccccgtacccgaaacggtacccgtacccgttaacccggg

SEQ ID NO: 43807 - DNA, 577 bp, Homo sapiens
  misc_feature: GYAE6OF02GAG4V.31.14.B03.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccncaggccccaggcaagggctggagtgggtgcatttanacaatttgatggagataaaaatttcgcagactccgtgaaggccgattcaccatctccagacgacccttccaaccatacgctgtatctaccaaatgaacatgganacagttagaagacacggactaacttattattgtgacgaaagtatttcggttaggttcgagtctaatacaatggtaggagtagggtgctacgactaccggtggggaccaagggactacgtggtaccaccgttctcctcacgtcctaccgaccgacggccctagttaccggtccctttaccccgtggtacccacccgttcccgtaccaacgtacgccctacccgg

SEQ ID NO: 43808 - DNA, 708 bp, Homo sapiens
  misc_feature: GYAE6OF02JANYA.31.14.B03.1.454.CMB.1.raw
  modified_base (261)..(261): a, c, t, g, unknown or other
  misc_feature (261)..(261): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggcccccaggccaaagggactgggagtggggtggctattttanactaatttgatggagaataaaaaattttacgcagactccgtgagggccgattcacatctccagacgaccccttaccaaccatacgctgtatcctacaaatgaacatgagactagttgaagtacgaacggctaaactttattagtttgtacgacgaaaagtacgtttggtttacggttcggaagtacgtattacgaacgtggttagggagtttaggggtcggccttaccgtacccgaccggttcgggggacctaacgggggacctaacgttcggtacccgtaacccggttcctacccgtacgtaccgacccccttcccggaaacccggaaaccggggtcccccttaacggttacccccgggggtttacccttccccccccgttagggtaccccccctaacccgttaccccctaaccccggaaacggtacccggaccctaacccccggg

SEQ ID NO: 43809 - DNA, 590 bp, Homo sapiens
  misc_feature: GYAE6OF02GNTGE.31.14.B03.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctgggggtacctgagactctcctgtgccatgtctgcgtctgaattcatcctcaggcactatggcatgcactgggtccnccaggccccaggcaaggctggagtggtgcatttanacaatttgattggagaataaaaaattttacgacagactccgtgaacgggccgattcaccatctccagacgacccttccaaccatacgctgtatctccaaatcgaaacatcggtagtacagttagaanacacggacaaactttattaattaggtgacgtaaagtacgttacgttaggtttcgagtcaatacaaatgtaggtagtagggtgctcgacaccgtggggaccagggaactacgtggtaccgaccgttctcccgtgacctccctaccaccgtaaccgggccctaagtccggttacccttcccccgtagccctaccctcccgtccaacgtcaccgtacccg

SEQ ID NO: 43810 - DNA, 921 bp, Homo sapiens
  misc_feature: GYAE6OF02IBVAG.31.14.B03.1.454.CMB.1.raw
  modified_base (163)..(163): a, c, t, g, unknown or other
  misc_feature (163)..(163): n is a, c, g, or t
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
tcagcagtagacgtcacgaccggtgctcgatttagtgtgagtagtttgggcgtggagtctgggttttccgtcgttgctcttttaagaggtgtccagtgtcaggtgcacctggtgatcgtggggagcgtggtccgcctgggggtccctgagactctcctgtgcntgtctgcgtctgaattcatcctcagcactagtggccatcgacacgtcgggtccncgaggccccaaggacaagggtacttggacgtacgggtgactaatttanactaatttgacgtaggtataattaaaaaattttacgacgtagactcgtacgaaggaccgtaatccgaacacttccgtaccgaaggtagtaacccccttaccaaacctaacgtaccgtaccgttacggtacttacccgttaccgaaaacgtaacgtaaaccgtacgttacgggtaccgtaaaccgttacggtttaacggtaaaccgtacccgaacggtaacccgttaaaccgttttaaacgttaacgtttttaaccgggacggtaaccggtaaaaaacggttttcggttttaaccgggttttacgggtttaaccgggtaaagtacccgttaaagtaaccggttaaaggtttacgggttaacggttaaaggtttacgggggtttaccggtccgttaaaccggtaacccggtaacccggttacgggggttacccgaaaacgggggttaaccctaccgggtttaacgggtaacccgttaacccgggtttacctacccggttaaccgtaccgggtaccccttaacccgggaaaacccggaaccgggtaccccggttaaaccgttcccggggtttaaccccgttacccccggttacgggtaaccccttaccccgttaaccccgtaaccccggtaacgttaccccggtacctttaaccccggg

SEQ ID NO: 43811 - DNA, 651 bp, Homo sapiens
  misc_feature: GYAE6OF02JCZFV.31.14.B03.1.454.CMB.1.raw
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggctgggagtgggtgctatttanactatttgatggagaattaaaaattttacgcagactccgtgaacggccgtattcaaccatctacagacgacccttccaaccactacgctgtatctaccaaatgaacagtggtanactagttagaagacgaacgactaacttattactttgtagtacgaaagtntttcggtttggttacgagtacaattacgtaagttggtaggtagttagggtcggtctaccgaccgtaccggtacggggacccgtaaggggaacctaacgtcgggtacctacccgtcctacccgtcgaccgtccctaccgaacccggaacggccccgtacgttcccgggttcccttcccccggtcggtacccctaccccgttacccgtacccaacggtaccgacccgtaccccggg

SEQ ID NO: 43812 - DNA, 718 bp, Homo sapiens
  misc_feature: GYAE6OF02G6AD3.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactggagtgggtggcatttatacaatttgatggagaattaaaaattttacgcagactccgtagagggccgattcaccatcctccagacgacccttaccaaccatacgctgtactcctcaaatgaacagtggtgactagttgaagacacggactaaacgtttattagtttgtacgacgtaaagtagtttacgttggttacgagtcctaatcctaaagttggtagggtaagttaggggttcggtaccgtcggtaaccgaccgggttacgggggcccgtaaacgggggaacctaccggttaccgggtccctaacccggtttcccgtacccttaccggtaccgtaccccttacccgaaccccggtaacggggtacccccgtaaccgtttcccggggttacccctttaccccccccggttacgggtacccctaccccccgtttacccccgtacccggtaaaccggtacccggtacccgttaacccccggg

SEQ ID NO: 43813 - DNA, 582 bp, Homo sapiens
  misc_feature: GYAE6OF02IVOJ6.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagaataaaaatttacgcagactccgtgaaggccgattcaccatctccagacgacccttccaaccatacgctgtatctaccaaatgaacagtggtgaactagttagaagacgacggactaaactttattagttgtagacgtaaagtagtttcgttggttcgagcattcaatgtaggagtagggtcgctcgacgaccgtggggccaagggacacgtggtccaccgtctcctcgacgccctccgaccgaacgggccctacgtccggtccctttcccccgtggcccctacccgtcctacccgaacggtccgcctacccgg

SEQ ID NO: 43814 - DNA, 843 bp, Homo sapiens
  misc_feature: GYAE6OF02HFV9L.31.14.B03.1.454.CMB.1.raw
tcagcagtagacgtcacgaccggtgctcgatttagtgtgagtagtttgggctgagcgtgggttttcctcgttgctcttttaagaggtgtccagtgtcaggtgcacctggtggaatcgtgggggaggcgttggtccggccgtgggggtccctgagactctcctgtgccatgtctgcgtctgaattcactcctcaggcactagtggctatcgacacggtcggtcccgccgaccggccccgagggacgaacgggtacgtgggaggtgggtggacttagtttataacttaagtttaggtagtagggtaaagtaaaactttaaaaaacgttttacgaacgtaacgtaccgttacccggtagggaaccgggtacccgtaactttacccaacccttaacgtttacccggttacccgaacggtaacccgttaaccccctttaaccccgaaaaccgtacgttacccggtaccgttaccggttaacctacccgttaaacctaaagtacgaaacgtaggttacggtacgaacgttaggttaacggaaacgtaaccgaccgttaacttaaccgtttaagtttagtttacgtagtaaccggtaaaaggtttcgtttacgggtttaggtccgagtaccgtaaagtcgttaaaggttggtaacggttaggttacgggtacgtccgtaccgtaaccgccgggtacggggaccgaaacggactacgtcggtaccgacccttccgtccgtaccgccgtacccgtaccgaaccggtacgggtccctacggttcccgtacccgttcccccgtaacgtccccgttacccgttcccgaaccgtaacggtaccgtcccgtaaccgg

SEQ ID NO: 43815 - DNA, 604 bp, Homo sapiens
  misc_feature: GYAE6OF02GZK3S.31.14.B03.1.454.CMB.1.raw
  modified_base (539)..(539): a, c, t, g, unknown or other
  misc_feature (539)..(539): n is a, c, g, or t
  modified_base (560)..(560): a, c, t, g, unknown or other
  misc_feature (560)..(560): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactcgggtcccgccaggccccagggccaagggactgggagtgggtgctatttatacaatttgatggaagtaattaaaaaattttacgcaagtacctccgtaggaacgggccgtattccaccatcctccagacgtacccttaccaaccataccgcttgtactcctacaaatgaactatggtacgaactagttagaacgacgacgactaaacttattattgtagacgtaaagtattcggtttgggtactagctagtactaagtggtaggagttaggggtgtctaccggactaccggtggggtacccaagggacttagtcggtaccaccgttctcacncgcctccaaccgacggtcccngtccgtccctccccgtagcctccctctaccgacgacgctaccgg

SEQ ID NO: 43816 - DNA, 632 bp, Homo sapiens
  misc_feature: GYAE6OF02IV0TK.31.14.B03.1.454.CMB.1.raw
  modified_base (260)..(260): a, c, t, g, unknown or other
  misc_feature (260)..(260): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (623)..(623): a, c, t, g, unknown or other
  misc_feature (623)..(623): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtgggtccgccaggccccaggcgaaagggtctgggaggtgggtgctatttanactaatttgagtggaagtaaattaaaaaagttttcgacaagtaccgtcggtaggaacgggccgtaattccaactcgtctaccagtaaccgacccttaccaacatacgctacgtactcctaaccgaaatacaacagtaggtacacgtagtagaactacgacgacagttacttaattagtagtacgaagtaagtgtttacggtagtcgtacgactactagacttgggtacgtaggtaggtacgctaccggacgtcgggcgtacggaacggtacgtcgtacggtcctaccgtcctcgacnccnccaccgacggtcccgtacctcggttcccggtcccgttaccgtccgacctccccgtacacgacncgtacccgg

SEQ ID NO: 43817 - DNA, 658 bp, Homo sapiens
  misc_feature: GYAE6OF02G4HZK.31.14.B03.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccaggccccagggcaagggctgggaggtgggtgctatttanactaatttgatggagtaattaaaaaatttcgacagactccgtagacgggccgattcaccatctccagacgccccttaccacactacgtctgtactctacctaaatcgaactacgtggtagaactagttaggaaacgacgacgactaacttatttagttgtagacgtaaagtgtttcggttaggtcgtagtacgtaatacgtaagtggtaggtagtacgggtgccttacggacctaccggtggggacccgtaagggacctacgttcgggtacctccgttcctccctacgaccgcccgtacccgaaccggtaacgggtcccctacgttcccgggttacccctttccccggtaccgtacccccacccgttcccctaccgtaacggtacccgacccgtacccggg

SEQ ID NO: 43818 - DNA, 635 bp, Homo sapiens
  misc_feature: GYAE6OF02JXMWO.31.14.B03.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
tcagcagtagacgtcacgaccggtgctcgatttagtgtgagtagtttgggctgagcgtggtttccgtcgttgctctttaagaggtgtccagtgtcaggtgcacctggtggaatcgtgggggaggcgtggtccggccgtggggggtccctgagactctcctgtgccatgtctgcgtctgaattcatcctcaggctactatggctatgcacggtcgggtccgccacggccccagggcaagggtcngggnggtgggtgactatttacactaatttgatgggaataattaaaaatttcgctagactccgtagagggcattcacntactcagactaccctacaacgntacncttagtactctacaaatgtaacagtggatacagttacgaaancggtaacgataacgtttaattactttgacgaagtaaacgttgtttacggtgggttacaggcctanactagtagngggtactagggtacgcagtaccacggtaggggctaggactgtcgtaccttgtcccgtcgactaccgaccctccgaacgtaacccgggccttacgttccccggtaccctttacccccggaccggtacccttacccccaccgttaccgaaaccggtcccgtaacccgttcccggg

SEQ ID NO: 43819 - DNA, 754 bp, Homo sapiens
  misc_feature: GYAE6OF02IQ7A7.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgattcatcctcaggcactatggcatgcactgggtccnccaggccccaggtccaagggactgggagtgggtaggctatttatactaatttgagtggaagtaataaaaaaagttttacgcaacgtactaccgtggaacgggccgtaatttccaccgtatcctacctaagacgtacccccgttaccaaccactacgactagtacttcctaccaaagtcgaaacagtaggtgaactagttgaaagaccgaacggactaacgttattagttgttacgaacgaaagtagtttacggttaggttcgaagtctaagttaccgtaaagttggtacgggtagttacggggtcggtaccgttaccgaacgtaccggttcgggggacccgtaaggggtaaccctacgggttacgggttaccccgtaacccgttccgttacccgtacgaccggtaccccgtacccggaaacccgtaaccggggcccctaaccggttaccgggttccccgtttacccccggtcgggtaaccccctaaccccccgtttacccgttaaccccgaaacgggttacccgtacccgttaacccccgg

SEQ ID NO: 43820 - DNA, 846 bp, Homo sapiens
  misc_feature: GYAE6OF02JTNDR.31.14.B03.1.454.CMB.1.raw
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctggtgccatgtctgcgtctgaattccatcctcaggcactatggcatgccactgggtccgccaggccccaggcgaaggggactgggaggtggggtcggactaagttttanaacgtaaagttttgaacgttgggaagtaaattaaaaaaagtttttccggactaaggtaaccttccggttaggaaacgggcccgtaagtttaccgacccgtaattaccttacccgaaggtaacccgtaacccctttaccaaaacctacgttaaccggacttacggtaactacccgtaaccaaaaacgttacgaaacctaggtacggttacggaacctaaggttacgaaaggacctaacgggtacttaaaccttagttaattggtacgaacgtaaaaggtaacgttttcgggttacggttacgtaagtacctaagttaacgaagttcgggtagggtaagttacggggtacgtaccgttacgggtaaccgtaccggtacgggggaaccgaaacggggtaaccctaaccgggtacggttacccgtaacccggtcccttacccgtaccgtaaccggtacccccttaccggaaccccgttaacggggccccttaaccggttcccggttaccccgttaccccccggtccggtaccccttaaccccttacccgtaccccggtaaacgtcccgtaacccgtaccccgg

SEQ ID NO: 43821 - DNA, 690 bp, Homo sapiens
  misc_feature: GYAE6OF02HM8HA.31.14.B03.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcacgtgggtcccnccacggccccaggccaagggactgggagtgggtgctatttanaactaatttgatggagaattaaaaaattttacgcaagactccggtggaacgggccattccaccaattcctaccagacgtacccctttaccaacctatacgctagtactcctaccaaatcgaacagtggtagaacaggttagaaacgacgacggtactaaactttattattagtgacgtaaagtgtttacgtttggtacgtacgactacttacgaagttggtcgggaagttacggggtggacctacggaccgtaccggtggggacccaaggggtaacccagttcggtaccgacccgttcctaccgtaccgtaacgtccctacccgaacccggacggggtaccccctacggtttccggttaccccctttaccccccgtcgggtacccctaacccccgttcccttaaccccggaacggtaccgccccgtaacccgg

SEQ ID NO: 43822 - DNA, 643 bp, Homo sapiens
  misc_feature: GYAE6OF02IT70Z.31.14.B03.1.454.CMB.1.raw
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccagggccaagggactgggaggtgggtggcatttatactatttgatggaagtaattaaaaaattttacgacagactccgtgaagggccattcaccatcctcagacacccttaccaaccataccgctagtactctacaaatanaacatggtnactagtgaagacacggataacttattagtttagtgaacgtaaagtatttcggttgttacggagtactagtacgtaagtaggtagggtagttaggggtggtacgtaccgacgaccggtggggacccgaagggaacctacgttcggtaccaccgttcctaccgtacacgtccctaccgaaccgtaaccgggtcccttaacggtccggttacccccttcccccggtacgtccccgtacccctaccctacccgaacgtaccgcccgtacccgg

SEQ ID NO: 43823 - DNA, 674 bp, Homo sapiens
  misc_feature: GYAE6OF02GIFFM.31.14.B03.1.454.CMB.1.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (390)..(390): a, c, t, g, unknown or other
  misc_feature (390)..(390): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccacggccccaggcaagggactgggagtgggtggctatttanactaatttgatggaagtaattaaaaaatttcgacagactccgtaggaacgggccgtattcaccgatcctaccagaccgtacccttaccaaccataccgcttagtactcctaaccaaatacgaaactagtggtanaactaggttacgaaagaccgacggactaactttagttattgtagacgtaaagtgtttcggttggttacgagtactatacgtaagtggtaggtagtagggtgactcgacctccggtagggccgaagggaaccctacgttcggtaccgtaccgttcctacccgtacgaccgtacccctacccggaaccggtaaccgggtcccctacggttccccgggttcccctttacccccggtcggacccctaccccgttacccgtacccgtaacggaccgtccctaacccggg

SEQ ID NO: 43824 - DNA, 959 bp, Homo sapiens
  misc_feature: GYAE6OF02H6K2H.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtccgattctctcctcaggcactataggcgatgcgacgtcgggtccggccgacggcccgacggacgaacgggacgtggaggtgggtggtcgtactttatactaatttagtagtaggagtaaattaaaaaagttttaacgtcgaagaccgttaccggtaggaacgggaccggtaacttacgaccctaatccttaccgaacgacgtacccctttacccaacctaacttaccgtctacgttacttacctaccctaaaagtacgtaaccgaagttcgggtacgaacgttaacggtttacggtaaaacggaacctaccggggtaacttaaaccgttttaagttttagtttacgggttagggtaaccggtaaaaggttacgtttttaccgggttttacgggtttaacgggtaaccggtaactacgtttaaccgtaaaaggttgggttagggtaaacgggttaggggttacggggtaccttacccgggaaaccgtacccggggttaacgggggacccgggtaaacggggtaaaacccgttaccggttaccggggttacccgtaacccccggttaccgttaccccgttacgaccccggttaccccgttaaccccgggaaacccccggttaacccggggggtaccccccttaaccggtttccccggggtttaccccccttttaccccccccggggtttacccggaccccccgtttaccccccgtttaaccccggttaaccccccggaaacggttaacccggttaccccccgttaccccgggtttacccccgggggg

SEQ ID NO: 43825 - DNA, 565 bp, Homo sapiens
  misc_feature: GYAE6OF02G2D0L.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggccaagggactggagtgggtggcatttanacaatttgatggagataaaaaattttcgcagactccgtgaaggccgattcaccatctccagacgacccttccaaccatacgctgtatctccaaatgaacatggtgactagttgaagacacggcaacttattattgtgacgaaagtatttcggttggttcgagctatcaatgtaggagtagggtggctcgacacgtgggccgagggaacacgtggtcaccgtctcctcacgcctccaccgaacgggccccagttcccggtcctttacccccgtgggaccctaccccgtcctaccgaacgtcgcctaacccgg

SEQ ID NO: 43826 - DNA, 585 bp, Homo sapiens
  misc_feature: GYAE6OF02I2ZYT.31.14.B03.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaatttgatggagaataaaaaattttacgacagactccgtgaagggcgattcaccatctaccagacgtacccttaccaaccataccgctgtactctaccaaatgaacatggtnacagttgaagacacggactaacttattattagtgacgaaagtattcgttggttcgagtcatcaatgtaggagtagggtgctcgacaccgtggggccagggaacacgtggtcaccgttctacctcagtccctaccgaaccgaacgggccctaagttccgggtccctttcccccgtaggccctaccccttaccctcccgaacgtacgccctaacccgg

SEQ ID NO: 43827 - DNA, 766 bp, Homo sapiens
  misc_feature: GYAE6OF02HAVGL.31.14.B03.1.454.CMB.1.raw
  modified_base (173)..(173): a, c, t, g, unknown or other
  misc_feature (173)..(173): n is a, c, g, or t
  modified_base (442)..(442): a, c, t, g, unknown or other
  misc_feature (442)..(442): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccgctcggggtccgggtctaggactctcctcgtgccactgtctngtctgatactatctcctaggcactatggcgatgtcgactcgggtccggcccacggacccgaccggacgaacgggaacggtcggtaggtggggttggggaccatttaatttaaccgaaatttagttagtaggtaaggtaactaaaaaaatttttaaaacggtcgaacgtaacgtaccgttacggaagggaccggacttactaaccactacttcccaagacgaccccttaccaaccaataccgtactgtaacttctcctaaaatacgtaanaactggtcgtaacgagtttacggaagtaccaacggccgtaaacttactttagtttcgtacggacgtaaaggtaaacttcgggttttggtaccggtagtacgacttaacgtaagtggttagggtagtaagggtttgggaactcccggtaaacggacccggtacgggggaccggaccggttaaacggaacgttccgggtacgtaccctccgttaccctcgtaagccccttacccgaccaaccgggggaccctccggttaccggttccccgttccccgttcccgggcctaccccttccccgttacccaaggaccggtcctaccccgg

SEQ ID NO: 43828 - DNA, 672 bp, Homo sapiens
  misc_feature: GYAE6OF02GUFYL.31.14.B03.1.454.CMB.1.raw
  modified_base (252)..(252): a, c, t, g, unknown or other
  misc_feature (252)..(252): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgcaggccccaggcaagggctgggagtgggtgctatttanactaatttgatggagaataaaaacttttacgcagactccgtagaaggtccgattcaccatcctaccacgacgaccccttccaaacctataccgctagtactctacaaatcgaactagtgganacgagttagaacgacgacggtactaactttattatttgtcgtaacgtaaagtatttcggttaggttaccgagctaattacgtaagtggttgggtaacgttggggtacggccttacgaccgtaccggttcggggaccgtacgggaaccgtacgttcgggtacctacccgttctcccttacgacgtccctacccgaacccgtaaccggggcccctacgttccccgggttccccttacccccccgttggacccccttacccccgttccccgtaacccgaacgtaccggcccttaaccccgg

SEQ ID NO: 43829 - DNA, 659 bp, Homo sapiens
  misc_feature: GYAE6OF02JFL72.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtggcatttatacaatttgatggagaataaaaattttacgcagactccgtgaagggccgattcaccatctaccagacacccttaccaaccatacgctgtatctacaaatgaacatggtgactagttgaagacacgactaacgttattagtttgtagacggtaaagtacgtttcggtttacggttacgaggtacctaattacgtaaagtcggttagggaattagggggtggtccgttacgaccgtaccggtcggggaccgaaccgggtaacgtacgttcggtaccgaccgttccgtcccgtacacgtacccttacccgaaccgaaccgggtccccaacgttcccgggttcccttacccccggttcggaccccgttaccccgtcccgttaccgaaccggtaccgtaccccgtaacccgg

SEQ ID NO: 43830 - DNA, 1025 bp, Homo sapiens
  misc_feature: GYAE6OF02JBAO8.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactagtggacatcgctacgtcgggtcccgaccgacgggccccagggccgaaagggctggggagtggggtggctatttatacgtaagtttgaagtaggaagtaaattaaaaaagttttaccgactaacgtaccgttaccggtaggaaacggggaccgttaactttacccgaacctacttacccgtacccgaacggtaacccgtaaccccctttaaccccgaaaacccgtaaacgttaacccggttaccgttacggttaaaccctttacccgtaaaaccgttaaaacgttaaccggtaaaaccgtaaccggtttaaggggttaaccggtaaaaccgtttacgggtttaaaacggaaaaccgggtaaccgtaaaacccgggttaaccctttaaaaaccgttttaatttttaacgggttttacgggttaaacggtaaaccgggttaaaaaggttacgtttttaaacggggttttcgggtttaaccgggtaaacgtaaccgttaacggttaaaccgttaaacggtttacgggttaaggggtaaacgggtttacgggggtttaccgggtaccggttaaaccggtaacccgggtaacccggggtttccgggggaaacccggtaaacggggtaacccgttaaccgggttcgggttaaccccgttaacccgggtttaccctacccggttaacctacccgggtaccccgttaacccccgtaaaccgggaaccccggggtccccgttaaccggttaccccggtttaccccgttccccccggtagtacccccggttaacccctccccgttaacccggaaccggtacccggtacccgttaccccggg

SEQ ID NO: 43831 - DNA, 615 bp, Homo sapiens
  misc_feature: GYAE6OF02HNV1N.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggactggagtgggtgctatttatacaattttgatgggaagtaattaaaaaaattttacgacaagtactccgtaggaagggccgattccaacctatcctaccgagacgaccccttaccaaccatacgctagtactctaccaaatacgaaactatggtagaactagttagaacgacacgactaaacttattattgtagacgtaaacgtattcggttggttacgagtacattacaaagtggtaggaagttagggtcgtactacgacgtaccggtcgggggacctaagggacacgtcggtaccaccgttccacctcgactcccgtaccaccgaacggcccaagtccgttcccttccccgtgcccaccctccaccaagccgcctaccgg

SEQ ID NO: 43832 - DNA, 658 bp, Homo sapiens
  misc_feature: GYAE6OF02IAYIJ.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcacgtgggtcccgccaggccccaggcaagggactgggagtgggtgctatttanacaatttgatggagaataaaaattttacgcagactccgtgaaggccgattcaccatctcagacgacccttccaaccatacgctgtatcctaccaaatcgaaccatcggtagactagttagaaagcaacggactaactttattattgtagacgtaaagtatttcggttagttacgagtactatacgaagttggtaggtaagttaggggtgtcctacggacgtaccgtggggacctaaggggaacctacgttcggtacccgtaaccgtccgtacctaccgaccgtccctacccaacccggtaaccgggccccttaacgttcccgggttacccctttcccccccggtaggtccccctaacccccgttccccgtaaccccaacgggtacccgacccgttaaccccgg

SEQ ID NO: 43833 - DNA, 791 bp, Homo sapiens
  misc_feature: GYAE6OF02G2G2L.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccnccgacggcccccgaggacgtaaggggactggggaggtggggtggcttaattttaagtaactaagtttgagtagggtaaataaaatttaaaaaattttccgacaacgtaacgtccggtaggaacgggccgtattaccacctatcctaccgaagaccgtaaccccttaccaaacctacttaccgcttacgttaacttacctaacctaaaatacggaaaactgttaggtacgacgtaaggttacgaaacggtacgaaccggtaccttaaaactttatttagtttacgtaggtaaccgtaaaaggtttacttttcgggtttaggttaccgaagtctaaattactaaaggttggtaggtaacggttaggggtacgtcgtacgtaaccgtaccgggtacggggaaccgaaacggggaacttaccgggtcggttacccgaccgtttccctaccgtaccgacccgtcccctaacccggaaccggtaacccggcccgtaccggtttccccgttcccccgttacccccgttaccgacccctaccccgttacccgaaccgtaacgacccgtacctaccccggg

SEQ ID NO: 43834 - DNA, 719 bp, Homo sapiens
  misc_feature: GYAE6OF02JNE1H.31.14.B03.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccaggccccaggcaagggctgggagtgggtggactatttanacgtaatttgagttggaagtaataaaaaattttacgcagtactccgtaggaacgggccgtaattccgaaccgtatccgtcccgaagtacgtacccccttccgaaaccataccgctagtactccgtaccaaatcgaactaagtggtacgaactaggttagaacgaacgacgtactaacttagttatgtacgacgtaaagtcgtttacggttaggtcgagtactaagtaccgtaattggtaggtagttaaggggtcggtccgtacgtaaccgtaccgggttcggggaccgtaacggggtaacctacggtacggtcccgtacggttaccctccgtaccgtacgaccccgttaccgaaccggtaaaccggggtccccgtaggttcccgggttacccccttcccccgggttacgtaccccgtaccccttccccgtacccggaaaccgtaccgaacccgttaccccgg

SEQ ID NO: 43835 - DNA, 613 bp, Homo sapiens
  misc_feature: GYAE6OF02GX3CC.31.14.B03.1.454.CMB.1.raw
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcaagggactgggagtgggtggctatttatactaatttgagtggagaattaaaaaattttacgacagactccgtgaagggccgaattcaccatcctccagacgaccccttccaaccatacgctgtatcctacaaatnaaccagtggtnaacgtagttaggaaacgtacacggactaaacttatttattggttagacggtaaatatttcggttaggttacggagctatacaagttggtggtagttagggtgcctcggaccncgtgggccaagggacacgtcggtcctaccgtcctcctacacgtcccaccgaaccgaccgggtcccacgtcccgttcccgtcccccgtaggtcccctaccctccctacccaacgtaccgcctacccgg

SEQ ID NO: 43836 - DNA, 666 bp, Homo sapiens
  misc_feature: GYAE6OF02F4VR9.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccgccaggccccaggcaagggctggagtgggtgctatttanacaatttgatggagaataaaaaattttacgcagactccgtagaagggccgattcaccatctccagacgacccttccaaccatacgctgtactcctaccaaatgaaacagtggtagaactagttagaagacacggactaactttattagttgtgacgaaagtcgtttcgttggttcgagctaatactaatggtggaagttaggggtggtcctacgaccgtaccggttcgggggacctaaggggaactaccggttcggtaccctacccgttcctaccctacgaccgtccccgttacccgaacccggtaaccgggtcccctaacggttccccgggttcccccttttacccccccggtcgggtacccctaacccccgtttccccgtaacccgaacggtaccgtcccgtaaccccggg

SEQ ID NO: 43837 - DNA, 543 bp, Homo sapiens
  misc_feature: GYAE6OF02FI3GR.31.14.B03.1.454.CMB.1.raw
  modified_base (253)..(253): a, c, t, g, unknown or other
  misc_feature (253)..(253): n is a, c, g, or t
  modified_base (395)..(395): a, c, t, g, unknown or other
  misc_feature (395)..(395): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtcccgccaggccccaggcaagggactggagtgggtggcatttanacaatttgatggagataaaaaatttcgcagactccgtgaagggccattcaccatctccagagacccttccaaccatacgctgtatctccaaatgaacatggtgacagttagaagacacggcaacttattatgtgacgaaagntttcgttggttcgagcatcaatgtggatagggtgctcgacaccgtgggccagggacacgtggcaccgtctcctcacgcctccaccgacgggcccagttccggtcccttcccccgnggtcccaccctccctaccaagtcgcctaacccg

SEQ ID NO: 43838 - DNA, 710 bp, Homo sapiens
  misc_feature: GYAE6OF02IQ391.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcggggtccgccgacggccccagggacgaaggggacgtgggaggtggggtggctatttatactaatttgatggaataattaaaaatttcgacagactcggtagaggccgtatcacatcctaccagactacccttaccaacactacgcttagtactactaccaaatacgaacagtggtacgataggttagaagaacacgtactaatttatttagttgtagacgtaaagtacgtttcggttaggttacgagtactagttacgtaagttggtagggtaagttagggtcggtacgtaccggtaacgaccggggttacggggaccgaagggtaacccgtaacgggtccggttaccgtaccccgttccttccctacgacccgtacccgtacccgaacccggtaaccgggtccccgtaccggttccccggttacccccgttcccccggtaccggtaccccctaccccgttcccgtaacccgtaaccggaccggtacccctacccgggg

SEQ ID NO: 43839 - DNA, 601 bp, Homo sapiens
  misc_feature: GYAE6OF02G682H.31.14.B03.1.454.CMB.1.raw
  modified_base (365)..(365): a, c, t, g, unknown or other
  misc_feature (365)..(365): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggctatttatacaattttgatggagaataaaaaattttacgcagactccgtgaagggccattcaccatctccagacgacccttccaaccatacgctgtatcctaccaaatgaacatggtnactagttagaagacacgactaactttattattgtgacgtaaagtagtttacggttggttacgagtctatctaagtgtaggtagtaggggtgccgtcgacnccggtgggccgagggactacgtggtccaccgtctccgtcacgtccctccgaaccgacgggccccacgttcccggttcccttccccccgtggtcccctaccccgttccctacccgaacggtccgacccgtaccccgg

SEQ ID NO: 43840 - DNA, 881 bp, Homo sapiens
  misc_feature: GYAE6OF02JL772.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggcccaggcaagggctggagtgggtgctatttanacaatttgatggagtaattaaaaattttacgacagtaccgtaccggttaggaacggggtccgaacgtttaccaaccacttacctacccgaacggaaccgtacccctttacccaaaccctataccggacttacgttaacttacctaccgtaaaattcgaaacgaacgtttcgggttaacgaacttaacggtttaacggaaacggaacctaaccgaaacggtaccctaaaacgtttttacttttaacgtttacgtttaacggaaccggtaaaaggtttaacgttttacgggtttttacgggtttaacgggtaaacgtaaccgtaacgttaaaccgttaaagtttagggttacggggtaaagggtttaacgggggtcgggttaaccgttacccggtaacggttaccccgggtacgggggggtaaccccgtaaacggggggaaccgttaaacccgttcggggttaacccgtaccccggtttaaccgttcccccgtagttaacccgggccccttaccccggaacccggtaaaccgggtccccgttaaaccggttcccggtttacccctttacccccggttaccggtccccgtacccccttacccgttaccccgaacggtaccgttacccccgg

SEQ ID NO: 43841 - DNA, 545 bp, Homo sapiens
  misc_feature: GYAE6OF02F7UMC.31.14.B03.1.454.CMB.1.raw
  modified_base (215)..(215): a, c, t, g, unknown or other
  misc_feature (215)..(215): n is a, c, g, or t
  modified_base (409)..(409): a, c, t, g, unknown or other
  misc_feature (409)..(409): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccacggccccaggcaagggactgggagtgggtgctatttatacaatttgatggagaataaaaaatttacgcagactccgtgaacgggccattcaccatctccagacgaccccttcaaccatacgctgtatctaccaaatgaacatgtagactagttagaagacacggacaacttattattgtagacgtaaagtnttcgttgttcgagcatcaatgtggagtagggtgctcgacaccgtgggccagggacacgtgtcaccgtcnccgtcngcctacaccgaggccctagtcccgtccttccccgtgcctaccctcctccaagcnctacccg

SEQ ID NO: 43842 - DNA, 955 bp, Homo sapiens
  misc_feature: GYAE6OF02H5R78.31.14.B03.1.454.CMB.1.raw
  modified_base (153)..(153): a, c, t, g, unknown or other
  misc_feature (153)..(153): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggcttggagctgggttttcctcgttgctcttttaagaggtgtccagtgtcaggtcgcacctggtggaattctgggggaggcgtgggtccggccgtgggggtcccnggagactctcctgtgccatgtctgcgtctgaacttcatcctcaaggcactatggcatgcacgtgggtccnccgaggccccaggccgaagggactgggagtgggtggctagtttanactaatttgagttggaagtaattaaaaagttttacgactaacggtacgtccggtaggaaacggggcctaagttcccaaccgtacttaccgttaccgaaggtaccgtaacccctttaccgaaacccgtagtaacccgtacttacggtaaccttacctaaccgtaaaattacgaaaaccgtagttcgggtaagtaaccgtaaggtttacggaaaacgtaccgtaaccgggtaaccttaaaccgttttattaagtttcggtaacggtaaccggtaaaacggttacgttttaccgggttttacgggttaaccgtaacggtactaaacgttaacccgtaaggtttacggtaacgggtaacggtttaacggggttacgggtaccgtttacccgggaaaccgtaacccggggttacggggggttaaccccggaaaacgggggtaaccccgttaaaccgggttcccgggtttaaccccggtaaaccccgggttttaccccgttacccggtaacccgtaacccggtaccccctttaccccgggaaaccccggtaacccgggggtccccttaacccgggtttccccgggttaaccccccgtttttaccccccggaaccgggttacccccgtaaccccccggttaccccgtttaaccccggaaaccgggttaccccggaccccgtttaacccccgggg

SEQ ID NO: 43843 - DNA, 611 bp, Homo sapiens
  misc_feature: GYAE6OF02IT935.31.14.B03.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
  modified_base (501)..(501): a, c, t, g, unknown or other
  misc_feature (501)..(501): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggactggagtgggtgcatttanacatttgatggagtaataaaaatttacgacagactccgtgaaggccgattcactatctccanacgacccttccaactatacgctgtatcctactaaatgaacagtggtagactagttagaagacacggactaacttattattgtagacgaaagtagttcgttggttacgagtctatcaagtgtaggtagtagggtgcttcgacgtaccgtgggaccacgggaacacgtacggtccgaccgtccgtaccncgtacgtcccttccgaaccgtaacgggtcccctacggttacccggtccctttacccccgtgggacccctaccccgttcccgtacccgaacggtacccgtcctaaccccgg

SEQ ID NO: 43844 - DNA, 794 bp, Homo sapiens
  misc_feature: GYAE6OF02JFNZN.31.14.B03.1.454.CMB.1.raw
tcagcagtagacgtcacgaccggtgctcgatttagtgtgagtagtttgggcgtgagctgggttttcctcgttgctcttttaagaggtgtccagtgtcaggtgcacctggtggaatctggggaggcgtggtccggcctgggggtccctgagactctcctgtgccatgtctgcgtctgaattcatcctcaggcactatggccatgcactgggtcccgccaggccccagggcaaagggctgggagtgggtggcatttatacaatttgatggagactaaaaattttacgactagactaccgtggaacgggccgattcgacctatccgtaccaggtacgtaccccttaccaaccctactaccgacttacgtaactccgttacccaaaattcggaaactacgttcgggtagtaccctaagtttaggtaaacgaccaaccgggacctaaacctttaattttaattcgggttaagaccggtaaaagtacgtttaccggttttagggttacgtaggacgtaacttactaaacgttggttagggtatttaacggggggttcgtaccgttaccggtaaacccgtccggttagggggggtaccccaacggggtaaacccgacgttacggggttaccctaacccggtccgtttacccgttaccgacgttaccctaccccgtaaccccggtaaacccggggtccccgtaaacgtttcccggggttcccctttaccccccccggttaggtaccccgtaacccccccgttccgttaccccgaacggtaacccggggtccctaaccccggg

SEQ ID NO: 43845 - DNA, 723 bp, Homo sapiens
  misc_feature: GYAE6OF02IM79W.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccgccaggccccaggcgaagggactgggaggtgggtggctatttatactaagtttgagtggaagtaaattaaaaaattttacgacaagtactccggtagaacgggccgtattaccaccatcctaccagacgaccccttaccaacctactaaccgcttacgtactcctaccaaatcgaacagtacggtagaagtaggttagaacgtacgaacggtacctaacgtttacttagtttggtacgaacggttaaagtacttttacgggttcggtttacgagtctagtactaagtaggtacggttaaggtggggtacggtccgtaccggtacgtaaccgggtcggggaaccggaacgggaacgtacgggttccggtccgtaacccgttcctccctacgaccgtaccctacccgaaccggaaccggggtccccttacggttcccggttccccgttcccccgttcgggtacccctacccgttccccgtaaccgaaacggtacccgacgttaccccgg

SEQ ID NO: 43846 - DNA, 635 bp, Homo sapiens
  misc_feature: GYAE6OF02HK3UJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtgctatttatactaatttgatggagtataaaaaattttacgacagactcgtgaagggccattcaccatctccagacgaccccttccaaccactacgctagtatctaccaaatagaaccagtggtacgacagttagaagacacgactaacttattattgtagacgtaaagtagtttacggttggttacgagtactatacaaattggtagtaggttagggtggtccgtacgacctacccggtaggggacccgaaggggaacctacgtacgggtacctacccggttctcccgtacctaccgcccttaccgaacccggtacgggtaccctacgtcccggttcccgtttccccccgtcgtacccacccctaccctacccgaacgcgccctacccgg

SEQ ID NO: 43847 - DNA, 692 bp, Homo sapiens
  misc_feature: GYAE6OF02GFGGG.31.14.B03.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttagggggagctacaacaggacaggcaggggcagcaagatggtgttgcagacccaggtcttcatttctctgttgctctggatctctggtgccgtacggggacatcgtgatgagccagtttccagactccctggctgtgtctctgggcgagaggccaccatcaactgcaagtccagccagagttgttttattcggccccacaataacaactactagcttggtaccagcaagaaagtaggacagccctacctaaactcctagtactttacgnggggtcctttaccgtaacccggggctaacgttccccgggggtttacctaaacccgtattcctaagtttggcctaggccgggttccgtaggggaccctagtttacacttctaccacacgtcagcacgccctggcacggctaggaacgtagtacggtggtacttaggttttaactaccgttgtacgtacgtaccgtaaactagtttacttacgtttccgttttaccgttacgttacgttttcggggacggtaacgggtaacccgtaagggtacggacgtaacgttaaccgaaaaacggtaaccgttcgggtacggtaccgttacggtaccgtaaccctacgttacccgtacggtttacccttaacggtccccg

SEQ ID NO: 43848 - DNA, 644 bp, Homo sapiens
  misc_feature: GYAE6OF02F2KYT.31.14.B03.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtggctatttanactaatttgatggagaattaaaaatttcgcagactcgtagagggccgattcaccatctaccgagacgaccccttaccaaccatacgctgtactcctaccaaatcgaactagtggtagactagttacgaagacgacgactaactttattagttgtacgacgtaaagtntttcggttaggttacgagtactatacgaagtggtaggtaagtaggggtgccttacgaccgtaccggtggggacccaaggggaacctacgttcggtaccctacccgttcctaccctcgaccgtccctaccgaacccgacgggtcccctacggttccccggttccctttccccccggaggtacccctaccccgtccctacccgaacggtccgaccctacccgg

SEQ ID NO: 43849 - DNA, 556 bp, Homo sapiens
  misc_feature: GYAE6OF02IUN5U.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaatttcatcctcaggcactatggcatgcactgggtccncaggccccaggcaagggctggagtgggtggcatttanacaatttgatggagataaaaaattttacgcagactccgtgaagggccgattcaccatctccagagacccttccaacatacgctgatctccaaatgaacatggtgacagttgaagacacggcaacttatatttgtgcgaaagnttcgtggtttcagnatcaatgtggatagggtgctcgacacctggggccagggaactacgtaggtccaccgttctccgtcagtccctccgaaccgacgggccctaacgtccgtccttcccccgtggccctacccctcctacccgaaggacgtcctaaccccgg

SEQ ID NO: 43850 - DNA, 606 bp, Homo sapiens
  misc_feature: GYAE6OF02HMX9T.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccncaggccccaggcaagggactggagtgggtgcatttanacaatttgatggagtaattaaaaattttacgacagactccgtagaaggccattacaccatctcagacgaccctccaaccatacgctgtactctaccaaatcgaacatggtanacgtagttagaagacacgactaacttattattgtagacgaaagtgttacgttaggtcgagtnagtacaagtggtaggtagttagggngtactcgactaccggtgggaccgtaagggacctaacggtggtaccgaccgtcctaccgtaccgacgtccctacccgaccgaaccgggtcccacgtccgtaaccttcccgttacccggtccgacccgtaccctcccgtaccgacgtacctacccgg

SEQ ID NO: 43851 - DNA, 570 bp, Homo sapiens
  misc_feature: GYAE6OF02GRYFS.31.14.B03.1.454.CMB.1.raw
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccaggccccaggcaagggactggagtgggtgcatttatacatttgatggagataaaaatttacgcagactccgtgaagggccgattcgaccatctccagagaccccttccaaccatacgctgtatctaccaaatgaacatggtnacagttgaagacaacggctaacttattattgtgacgtaaagtntttcggttggttcgagtcatcaatggtaggtaataggggtgctcgtacgaccgtggggccagggaacacgtggtccaaccgtctccctcgacgccctaccaccgacgggtccccagttcccggtccttcccccgtggaccctaccctcctaccgagtaccgcctacccgg

SEQ ID NO: 43852 - DNA, 595 bp, Homo sapiens
  misc_feature: GYAE6OF02GJADC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggcaagggactggagtgggtggctatttatacatttgatggagataaaaattttacgcagactcgtgagggccgattcacatctccagacgacccttccaaccatacgctgtatctccaaatgaacatggtcgacagttgaaagacacggactaaacttattagttgtagacgtaaagatttcgttggttcgagcatacaatgtaggtagtagggtggtctacgactaccgtcggggccgaagggacacgtggtcctaccgtctccgtcacgtccctaccaccgaacgggccccaagttcccgggtacccctttccccccgtcggcccctaccccgtacccgtacccgaacggtaccgaccctaccccgg

SEQ ID NO: 43853 - DNA, 865 bp, Homo sapiens
  misc_feature: GYAE6OF02GXL61.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgtctgaattcatcctcaggcactagtggcatgcacgtgggtcccgccacggccccaggacgaagggctgggagtgggtggctattataactaatttgagtaggaagtaaattaaaaagttttacggataagtaccgtaccggtaggaacgggccgtacttacgaaccacttcctaccgaacggtaaccctaaccccctttacccaaaccctaagttacccgtacgtacgttacctacccttaaccgtaaaatacgaaacttagtaggttacgaacgtacggttaacgaaacgaaccgtaaccggaactttaaacgtttaagtttagtttacggtacgtaacgtaaaacgttacgttttaccggtttagggttacgagtaacgtaacgttaacgtaacgtgggttaagggtaacgggtttacggggttcggttacccgttaaccggaaccgttacccggggtaccggggtacccggaaacgggggtaaccctacccgggtttacgggtaccccttaacccgttcccgtccgttacccggtaccgtacccctaccccggtaaccggtaacccggggtccccttaaccggtttcccccgggttaccccgtttcccccccggttaccggacccccccgttccccgtttaaacccccgaaccgttaaccggtaaccccggtcccttaacccccgggg

SEQ ID NO: 43854 - DNA, 695 bp, Homo sapiens
  misc_feature: GYAE6OF02H7VBC.31.14.B03.1.454.CMB.1.raw
  modified_base (337)..(337): a, c, t, g, unknown or other
  misc_feature (337)..(337): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggcgaaagggacctgggagtggggtaggctatttatacaatttgatggagataaaaattttcgcagactcgtgaaggccgtattcaccatctccacgagacccttcaaaccntacgctgtatcctaccaaatcgaacatggtagactaggttagaacgacaaccggactaaacttagttatttgtagacggtaaagtactttacggttggttacggaagtcgtaatacgtaaagttggtgggtaagttaggggttggaccttacggaaccgtacccggtgggggacctaaccggggaaactcgtacgggtaccacccgttaccgtccctacgtacgaccccgttcccgaaacccgtaacggggtcccccttacggttaccccgggttccccgttttacccccccggtcgggtacccctacccccgtttaacccctaccccggaaaacggtcccggacccgtaacccccgg

SEQ ID NO: 43855 - DNA, 605 bp, Homo sapiens
  misc_feature: GYAE6OF02JGOTB.31.14.B03.1.454.CMB.1.raw
  modified_base (364)..(364): a, c, t, g, unknown or other
  misc_feature (364)..(364): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggcccccaggccaagggactgggagtgggtggcatttatacaatttgatggagaataaaaattttacgcagactccgtgaagggccgattcaccatctccagacgacccttccaaccatacgctgtatctaccaatgaacataggtnacagttagaacgtacacggacaactttattattgtgacgaaagtactttggttcggttacgagtcatcaagtgtaggacgttgggtacggctacgactaccggtaggggccaagggtaaccacgtggtaccaccggtcctacccncgacgtcccttcccaaccggacgggtcccctagttccgggttcccttcccccgtggtccccaccccgttccctaccgaacgtacgccctaacccgg

SEQ ID NO: 43856 - DNA, 947 bp, Homo sapiens
  misc_feature: GYAE6OF02IHINH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgcccgacgggcccccagggaccgaaacggggacgtgggaggtggggtggctaatttaagtaactaagttttgagttagggaagtaaagtttaaaaaaaacgtttttacgaccgtaacggtaaccgttacccggtaggaaacggggtcccgtaagtttcccgaaccctacgtacccgttacccgaacggtaaccgtacccccctttaaccccaaacccgtaaacttacccggtacgttacgttaacttacctaacctaaaagtaccgaaaacctagttcgggtacggtaacgtaaggtttaaggaaacgaaacgtaaccgggtaaccttaaaacgtttaattttacgtttaggtaacggaaccggtaaaaggtttacgtttccgggttttacgggtttaccggtaaggtactaaacttaacgtaaacgtttaggggttacggggtaaaggtttaacggggggttcggtacccgttaccgggtaaccctaacccgggggttacgggggtaacccggaaacggggaaacccgtaaccgggttacggggttaccccaaccccggtttcccgtaacccgtacccggtaacccgtccccgttacccgaaaccccgggtaaaccggggtccccttaaccggttccccgggtttaccccgttccccccggtacggtacccccttaacccccgttaaccccgtacccgaaacgggttcccgtacccgtaacccccggg

SEQ ID NO: 43857 - DNA, 597 bp, Homo sapiens
  misc_feature: GYAE6OF02I3WJP.31.14.B03.1.454.CMB.1.raw
  modified_base (215)..(215): a, c, t, g, unknown or other
  misc_feature (215)..(215): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccagggcccccaggcaagggactgggagtgggtggcatttatacaatttgatggagaattaaaaatttacgcagactccgtggaagggccgattcaccatctccagacgaccccttccaaccatacgctgtatcctaccaaatgaacatggtgacagttagaagacacggactaacttattattgtagacgtaaagtntttcgtttggtcgagtcaattcaaagtggtaggtagtagggtcggctacgacaccggtggggccaagggaacacgtggtacacccgtctcctacacgccctaccaacgaaccgggcccctagttcccggtcccttcccccgtggtcccctacccctcccgttaccaacggtaccgcctacccgg

SEQ ID NO: 43858 - DNA, 676 bp, Homo sapiens
  misc_feature: GYAE6OF02GIC0P.31.14.B03.1.454.CMB.1.raw
  modified_base (186)..(186): a, c, t, g, unknown or other
  misc_feature (186)..(186): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggctgagcgtggttttcgcgttaggctctttaagaggtgtcagtgtcaggtgcacctggtggaatcgtgggggagcgtggtccggcctggggggtcctgagactctctgtgccatgtctgcgtctagaattcatcctnaggcactatggcatgcacgttggggcccgaccacgggccccaggaccgtaaggggacgtgggaggtgggtggatatttaatacgtatttggattaggaagtaattaaaaaagttttaacncagacttccgtagacgggctacttacacactgtaccagtacgacccttccaaccgntaccgtctagtatacctacgtaaacacgtaanacgttggacgtacgtaagttacgaagtaaacgaggttaaccctaagtttatttgttacggtaggacgtaaatagtttcggttacgggttgtacgntaacgtatagtaggtaggtaacgtagggtcgaccgtagaccgtaacggacgggtcggaacggacctacggtccggtacctccgtaccgtcaccgacgacctaccgaccgaaccggtcccgtaccggtcctttacccgtcccgtcggtacccgacccctaccggttaccaggtaccctccgtacccgg

SEQ ID NO: 43859 - DNA, 749 bp, Homo sapiens
  misc_feature: GYAE6OF02GRTH6.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccncaggccccaggcaaagggctggagtgggtgctatttanactaatttgatggagaataaaaatttcgcagactccgtagaggccgtattcgacatctaccagacgtacccttccaaccatacgctgtactctacaaatcgaactatggtagaactagttacgaaacgaacgtaacggtacctaaacgtttatttaacgtttacggttacggaaccgtaaaaggtacgttttacgggtttacgggtttaccggaagtaccgtaaacgttacgtaaacgttagggttaggtaaggtttacggggtacggtacccgttacggaccgtaacccgggttcgggggaccgtaacggggtaacctacggttcggtaccgtaaccgttcccgtaccttaccgacgtaccccgttacccgaaccgtaaccggggtcccctaacggtttcccggttacccccgttttaccccccggacggtacccccgttaacccccgtttaccccgtaacccggtaaacggtaccggtacccctttaaccccgggg

SEQ ID NO: 43860 - DNA, 598 bp, Homo sapiens
  misc_feature: GYAE6OF02G2IMY.31.14.B03.1.454.CMB.1.raw
  modified_base (372)..(372): a, c, t, g, unknown or other
  misc_feature (372)..(372): n is a, c, g, or t
  modified_base (487)..(487): a, c, t, g, unknown or other
  misc_feature (487)..(487): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccaggcccccaggcaagggctgggagtgggtggctattttatacaatttgagtggaagaattaaaaaattttacgacagactccgtgaagggccattcaccatctccagacgaccccttccaaccataccgctgtatctaccaaatgaacatggtnactagttgaagacacggactaacttattattgtgacgaaagtatttcgttggttcgagcatacatgtggagtagggtgctacgacaccgtggggaccagggacacgtcggtaccnccgtcctcctcacgtccctaccgaaccgaccgggcccctacggttcccggtacccttccccccgtcggtacccctacccccgttcccacccgtaacgaccgccctacccgg

SEQ ID NO: 43861 - DNA, 727 bp, Homo sapiens
  misc_feature: GYAE6OF02JBPJK.31.14.B03.1.454.CMB.1.raw
  modified_base (203)..(203): a, c, t, g, unknown or other
  misc_feature (203)..(203): n is a, c, g, or t
  modified_base (334)..(334): a, c, t, g, unknown or other
  misc_feature (334)..(334): n is a, c, g, or t
  modified_base (400)..(400): a, c, t, g, unknown or other
  misc_feature (400)..(400): n is a, c, g, or t
  modified_base (573)..(573): a, c, t, g, unknown or other
  misc_feature (573)..(573): n is a, c, g, or t
tcagcagtagacgtcacgaccggtgctcgatttagtgtgagtagtttgggctgagcgtgggtttcctcgttgctcttttaagaggtgtccagtgtcaggtgcacctggtggaatctgggggaggcgtggtccggcctggggggtccctgagactctcctgtgccatgtctgcgtctgattcatcctcaggcatatggcatgcncgtgggtccgccacggccccaggcgaagggtactgggaggtgggtcggctaattatactatttgatggaataaattaaaaacttttcggacagtaccgtccggtaggaacgggtcctattacccgaacctnttccgcaacggacctaaccccttaccaaccctagtaccgtcttagtactaccttacaaatgaaacngtcggtagacgtagtacgaacgacgaacgtactaatttattagttacggtaggtacgtaaaagttcggtttacggtttacggtacggatacgtattaccgaaagttgggtacggtaaggttaggggtacgcgttacgaaccggtcgggtacggggaccgtaacggggtaaccncgggttacgtacccgaccgtttccgcccttaccgaccgtcccggtaccctaaccgggtaaccggggtcccttaccggttccccgttaccccgtttcccccggtacgtaccccgtcccccttaccggtaccgtaaccgtcgtcccgtaacccggg

SEQ ID NO: 43862 - DNA, 672 bp, Homo sapiens
  misc_feature: GYAE6OF02JV0EA.31.14.B03.1.454.CMB.1.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
  modified_base (402)..(402): a, c, t, g, unknown or other
  misc_feature (402)..(402): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggactggagtgggtggctatttanacatttgatggagaataaaaatttcgcagactccgtgaggccgattcacatctcagacgacccttcaaccatacgctgtatctacctaaatgaactagtggtagactagttagaagacacggactaacttattattgtagacgaaagtntttaccggttggtttaccgagtactaatacgaaacgttggtaggtaagtaggggttcgacgttaccggaccgtacccggtcgggggaccaaggggtaacctacggtaggtacccgtaacccgtccttacccgtacgacgtacccccttacccgaacccgaacggggtccccctacggttcccgggtttacccctttccccccggtaccgggtacccctacccccgttacccgttaccccgtaaacggtaccgtaccccgttaaccccggg

SEQ ID NO: 43863 - DNA, 604 bp, Homo sapiens
  misc_feature: GYAE6OF02HDARS.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccncacggccccaggcaagggctggagtgggtgctatttanacaatttgatggagaattaaaaaattttacgcagactccgtgaagggccgattcacatctccagacgaccccttccaaccataccgcttagtatcctaccaaatgaaacagtaggtgacagttgaagacacgactaactttattatttgtgacgtaagtatttacgttaggtttcgagtntacgtctaagtggtaggagtaggggtgccgtcgacgtccgtggggaccagggaccagtcggtaccaccgttactccctagacgtccctccgaacgaccgggccctacgttcggtacccctttccccgtggtacccctacccgttaccctaccgaacgtcgtaccctaacccgg

SEQ ID NO: 43864 - DNA, 692 bp, Homo sapiens
  misc_feature: GYAE6OF02G6ZHT.31.14.B03.1.454.CMB.1.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccncaggccccaggcaaggctggagtggtgcatttanactatttgatggagaattaaaaaattttacgacaagactccgtagaagggccgtaattccaaccgtatcctaccagacgaaccccttccaaaccactacgctgttatctacctaaatagaactatcggtanaacgtagttagaagacgaacggtactaactttattacttagtggtaacggtaaagtacgtttacggtttaggtttacgagtactagttacaaacgttggtaggttaggtaaggggttcgacgttaccggaccgtacccggtgggaaccgaggggtaaccacgttcggtacccgtaacccggttcctacctaccgtacctcccgtacccaacccggtaccggcccgtaacgtttcccggtcccttttacccccccggtggtaccccctaccccgttacccgacccggtaaacgtaccgtccttaaccccggg

SEQ ID NO: 43865 - DNA, 585 bp, Homo sapiens
  misc_feature: GYAE6OF02H9IB2.31.14.B03.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (371)..(371): a, c, t, g, unknown or other
  misc_feature (371)..(371): n is a, c, g, or t
  modified_base (492)..(492): a, c, t, g, unknown or other
  misc_feature (492)..(492): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggcccccagggcaaggggctgggagtggggtggcatttanacaatttgatggagataaaaaattttacgcagactccgtgaagggccgattcaccatctaccagacgacccttaccaaccatacgcttagtatctaccaaatcgaacatggtnactagttgaagacacgacaacttattagttgtgacgaaagtatttcgttggttcgagtcatacaatggtaggagtagggtggactcgacgaccgtggggccaaggggactacgtggtaccnccgtctcctcgacgcctacccaccgacgggcccagttccggtcccttcccccgcggacctaccccgtccctaccgaacgtaccgcctacccgg

SEQ ID NO: 43866 - DNA, 581 bp, Homo sapiens
  misc_feature: GYAE6OF02I26SG.31.14.B03.1.454.CMB.1.raw
  modified_base (254)..(254): a, c, t, g, unknown or other
  misc_feature (254)..(254): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactgggagtgggtggcatttanacaatttgatggagattaaaaattttacgcagactccgtgaagggccgattcaccatctcagacgacccttccaaccatacgctgtactctccaaatgaacatggtnacagttanaagacacggctaaactttattatttgtagacgaaaagtgtttacgttggttacgagacatacaatgtggataggggtggctacgacacgtcggggaccagggacacgtggtacaccgttctcctcagcctccaaccgaaccgggcccacgttccggtcccttaccccccgtgggacccctaccctccctacccgaacgtaccgcctacccgg

SEQ ID NO: 43867 - DNA, 895 bp, Homo sapiens
  misc_feature: GYAE6OF02IXOE4.31.14.B03.1.454.CMB.1.raw
  modified_base (184)..(184): a, c, t, g, unknown or other
  misc_feature (184)..(184): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggccgtgggggtccctggagactcctctccgatcgtctgtcgtctggtaacttnaattcctctacgcacgtatcggtacagtcgactaccgttcgggtccggtcccgtacggaccccgaaccgggcgaaacggggtaaccggtaggtacgggttaaggggtacggtcggaacgttttacgttaacgtaaactttagttaagtagggttaaggaaagttaaaaaaaacgtttttaaaaaccggttacccgttaacgtaacccgttacccggttacggtaaacggggtaccgggaacccgtttaaccgtaaccctaaccgttaccgtacccgtaaccggtaacgtaccccggtttaaccctaacccccgaaaacttaccggtaacgtaccggttaacctaccttacccggtaaaaacctaggttaaacccgaagttccggttaaggggtaaacctagtttaccggaaacggtaaacaaaccccggggtacctaaaactttaacgttttaacgttaagtttacggtcggtaaaaggtaacgtttaaccggtttacggtttacggtacgtacgtacgtatacgtaagtacggtagtagggttacggtcgtaccggtacgtaaccgtcgggaccggacggtacgacgtacgtacgttccgaacgtttccgtacctacgaccgtacctcccgacgaccggtacccgcggttacccgtcccttccgtccgtaccttacccgtccgtaacgacgtaccgtacctcctaccggg

SEQ ID NO: 43868 - DNA, 741 bp, Homo sapiens
  misc_feature: GYAE6OF02G5XEA.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactggggtcccgccacggcccccaggccgaagggactgggaggtggggtggctattttatactaatttgatggaagaattaaaaaattttacgcagactccgtagaagggccgattcaccatctccagacgacccttaccaaccatacgctgtatctaccaaatcaacatggtgactagttagaagacgacgactaacttattattgtacgacgaaagtatttcggtttaggttcgaggactacgtactaagttggtaggtaagttaagggggtggtaccgtcgtaccgtaccggttcgggggacccgtaaggggaaacctacgggttaccggtacccgtaacccggttcccttaccccgtaccgaccgtaccccgttaccccggaaccccggtaaccggggtaccccccttaacggtttcccccggggtttaccccctttaccccccccgggttcggggttaacccccccttacccccccggttacccctttaaacccccggaaccggttaacccggtccccgttaaccccccggg

SEQ ID NO: 43869 - DNA, 704 bp, Homo sapiens
  misc_feature: GYAE6OF02J1TU4.31.14.B03.1.454.CMB.1.raw
  modified_base (256)..(256): a, c, t, g, unknown or other
  misc_feature (256)..(256): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccaggccccaggccaagggctgggacgtgggtggctatttanacaatttgatggagataaaaattttcgcagactcgtgaaggccattcgaccatcctaccagacgtacccttccaaccatacgctgtatcgtaccaaatgaacagtggtagactagttagaacgacgtaaccgggactaactttagttatttgtagaacgtaaagtntttacggttggttacgagctatactaagttggtaggtacgtaggggttcggaccttacggaaccgtacccggttagggggtacccgaaggggtaaacctaccggttacgggttacctaacccggtttcccgttacccgtaccgacggttaccccctcccggaaccggtaacccggggcccctaacggtttacccgggttccccgtttacccccggtacggtccccgttaacccccgttacccgtacccggtaaacggtacccggtacccgttaacccccggg

SEQ ID NO: 43870 - DNA, 678 bp, Homo sapiens
  misc_feature: GYAE6OF02GDF7S.31.14.B03.1.454.CMB.1.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccnccgacggccccagggcaagggcctgggagtggggngctatttagactaatttgataggaagtaattaaaaaacgttttacgacaaggtacctccgtaggaacgggccgtattccaccatcctaccagacgtaccccttaccaaccatacgctagtactcctaccaaatcgaactatggtanacgtagttagaanacgacggactaactttatagttagtagagtaaagtgtttacggttggttacgagtactagtctaagtggtagggtagtgggtacgcgtacgacgccggttacggggaccgaagggaccgtacgtcggtaccctaccggtcctcccgtcgaccgtaccctcccgaaccgtaacccgggtccctaacgtttccccggggtacccctttcccccggaggtcccccttaccccgtccccgttaccggaaccgtacccggtcccgtacccgg

SEQ ID NO: 43871 - DNA, 542 bp, Homo sapiens
  misc_feature: GYAE6OF02IMZ1Q.31.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggctgggggtccctgagactctcctgtgccatgtctgcgtctgaattcatcctcaggcactatggcatgcactgggtccnccaggccccaggcaagggactggagtgggtgcatttanacaatttgatggagataaaaaaatttttacgcaagactccgtgaagggccgattcaccatctccagagacccttccaacatacgctgtactntccaaatgaacatggtnacattagaagacacggcaacttattatttgtnacgaaagtattcgttggttcgagtcatcaatgtgatagggngctcgacacgtgggccagggaccacgtggtcaccgtctacctcgagcctccgacaacggcccacgtcggtcccttccccgtggccacccttccnccaacgcgacctaccg

SEQ ID NO: 43872 - DNA, 532 bp, Homo sapiens
  misc_feature: GYAE6OF02G5QQY.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacaatttgatggagataaaaaattttacgcagactccgtgaagggccgattcaccatctccagagacccttcaaccatacgctgtatctccaaatgaacatggtgaacagttgaaagacaacggcaacttaattatttgtgacgaaagattcgttggttcgagcatcaatgtggatagggtgctcgacacctggggccagggaacacgtggtcaccgtctcctcacgcctccacaagggcccatcggtcttcccctgccaccctcctccaagacgcaccg

SEQ ID NO: 43873 - DNA, 748 bp, Homo sapiens
  misc_feature: GYAE6OF02G3P38.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagcgtgggtttctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccncgacggccccaggccgaagggactgggagttggggtggactattttatactattttagattgggaagtaattaaaaaaagttttacgacgtaagtacctaccggtaggaaggggcccgtaatttaccaacctactaccgttacccaggtacgtaaccccctttacccaaaccctaacttaacggcttacggttacttacctaccgtaaaattacgaaacctaagttggttagaactaggttagaaacgacgaacggacttaaactttatttaacttgtagacgtaaagtagttttacggttggttcgaagtctaatacaatggtaggtaggttagggtcgtcgtaccgactaccggtgggggacccaagggtaacacggttcggtccgtaacccggttcctacccttaccgacgtacccctaccgaacccgtaccgggacccccttaaggtccccggtttaaccccttccccccggttacgacccccgttacccctttaccccgacccgaaccggaccgtacccgttaacccgg

SEQ ID NO: 43874 - DNA, 842 bp, Homo sapiens
  misc_feature: GYAE6OF02HRDYS.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctagaattcatcctcgaggcactagtggcctaatcggactacgtcggggtcccgaccgacgggcccccagggaccgaaggggactaggggtaggtcggggtggctattttaacaacgtaatttgaatgggtaagtaaacttaaaaaattttcggactaacgtaccgttaccggtaggaaacgggtccggtaacttccaaccgattccgttaccgaacgacgtacccccttaccaacctaactacggtacttcgtaacttctaaccgtaaatacgaactagttacggtacgacgtaagttagaaacgtaaccgaacggtactaaaaccgtttattaacgtttagtagtaacggaaagttacggtttacgtttgggtacagtacgtatactaagttacggtagtacggttacgggtgaccgttacgtacccgtaccgggttggggaaccgtaacggggtaaccgtaccgggttacggtaacccgtacccgttcccggtttacccgtacccgaaccgttaccccctacccggtaaacccgggtaacccgggtccccgttaacccggtttcccgggtacccccttttaacccccccgggtcggtaacccccgttaccccccgtttcccgtaaacccccggaaggttaccccgtaccccttaaccccggggg

SEQ ID NO: 43875 - DNA, 675 bp, Homo sapiens
  misc_feature: GYAE6OF02G1EM3.31.14.B03.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcacgtgggtccnccacggccccagggccaagggactgggagtgggtgcatttanactaatttgatggaagaattaaaaatttacgacagtactcgtgaaggccgattcacatcaccngacgacctccaaccatacnctacgtatctacaaatcgaaacngtaggtacactagttagaacgaacacggactaaactttatttaatttacggtagacggtaaaagtggttttacggttagggtttaccgaagctaagtactaaagttcggttaggtaacgttaggggtcggacttacgaccgtaaccgggtggggaccgtaaggggaacctaccgtcggttaccgacccgttcgtccctccgacgtaccctaccgaacccggtacgggtccccgtacgttcccgggttcccttcccccccggtaggtaccccctaccccgttccctacccgtaaacggcctaccccgttacccggg

SEQ ID NO: 43876 - DNA, 639 bp, Homo sapiens
  misc_feature: GYAE6OF02F015A.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (628)..(628): a, c, t, g, unknown or other
  misc_feature (628)..(628): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggtccnccaggccccaggcaagggactggagtgggtgctagtttanactatttgatggagtaataaaaatttacgcagactcgtagaacggccattcaccatcctcagacgacccttaccaacatacgctgtatctaccaaatcgaaactntaggtnacaggttgaagaacgacggactaactttattaacttgtagaccgtaaagtctttcggttaggttacgaggtctatacgaagttcggtaggtagttaggggttcggtcctacggtaaccgtaccgggttcggggacccgaagggtaacacgtttcggtaccgtaccgtccttccctcgacgtccctacccgaacgaaccgggtcccctagttcccggttccccttccccgtacggtacccaccccttccgacctaccggtacncccgtacccgg

SEQ ID NO: 43877 - DNA, 582 bp, Homo sapiens
  misc_feature: GYAE6OF02HF20Y.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggctatttatacaatttgatggagataaaaaattttacgcagactccgtgaagggccgattcaccatctccagagacccttccaaccatacgctgtatctaccaaatgaacatggtgacagtgaagacacggacaacttattattgtgacgaaagtattcgttggttcgagtcatacaattgtaggattagggtcgctcgacaccgtggggccgaagggacacgtcggtacaccgttctcctcgacgtccctacccgaccgaaccggccctacgttcccggttacccttcccccgtacgacccctacccgtccctacccgaacgtaccgcctacccgg

SEQ ID NO: 43878 - DNA, 616 bp, Homo sapiens
  misc_feature: GYAE6OF02F4JY8.31.14.B03.1.454.CMB.1.raw
  modified_base (438)..(438): a, c, t, g, unknown or other
  misc_feature (438)..(438): n is a, c, g, or t
tcagcagtagacgtcacgaccggtgctcgatttagtgtgagtagtttgggtttaggggggagctacaacaggcaggcaggggcgagcaagatggtgttgcagacccaggtcttcatttctctgtttgctctggatctctggtgcccttacggggacattcgtgatgagccagtttccagacctccctggctgtcgtctcgtggcgagaggccaccatcaactgcaagtccagccagagtgttttattcggacccctacaataacaactacttagcttaggtaccagacagaaacgtagacagtcctacgaaactcctgactttactgggcttacacccgggctagttcccgggttccaaccgtattctattggactacgcggtctacgggacctatttcgactctcaacctatcagcagcctgcaggtctagaaagtntagtggacttaagttttacacgttgtacgatacaaactattagtactttcgtttacgtacgttaacgttttcgggacggtaacggtaaccaagggtcgtagtaccgtacgtaaaaccgtaccgtacggttacggtcctacggtacctaaccggtacttcctcggttacctcttaaccg

SEQ ID NO: 43879 - DNA, 774 bp, Homo sapiens
  misc_feature: GYAE6OF02JSIC4.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccacggccccaggcgaagggactggaggtgggtggctagttatactaattgattggaagtaattaaaaatttcgacagtactccgtagaaggccgtatcactatctaccgacgacgtacccttaccaactactacgtctgtacctactaccgtaaaatcggtaaactagttacgggtacgtaacgtaggttaacgaaacgaaccgtaaccggaaccttaaaccgttattttaacgtttaggtacggtaaccggtaaaagtttcgtttaccgggttttaagggtccggtaaagtcccgtaagttaacctaaggtttcggtacggggtaagtttaacgggggtcggtaccgtttaccggaacccggttacccgggtacggggaccgtaaaccgggtaacgtaccgggtcggttaccctaccgggttcccttacccggtatcccgtccgtacccctaaccggaaccgggtccccctaaggtttccccggtacccttccccccggttaacgccccgttaaccccttacccgacccgtaaccggtacccgtcgtacccccgg

SEQ ID NO: 43880 - DNA, 720 bp, Homo sapiens
  misc_feature: GYAE6OF02FETUO.31.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (353)..(353): a, c, t, g, unknown or other
  misc_feature (353)..(353): n is a, c, g, or t
tcagcagtagacgtcacgaccggtgctcgatttagtgtgagtagtttgggctgagcgtggtttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggctggagtgggtgcattttanacaatttgatggagattaaaaaatttcgcagactccgtgaagggccattcaccatctccagacgacccttccaaccntacgctgtactctaccgaaatgaacngtggtgacagttagaagacacggtacaacctttattacttcggtagtaccgtaaagtacttttcggttagggtttacggagtaccgtaacttcctaaagtcggttagggaagtttaacgggggtcggtacccgttacggtaacctaccccgggttagggggcccaaggggggtaaaccctaccgttcgggttaccctacccggttccttaccccgtacgaccgttaccccgttacccaacccgggtaaaccggggtcccccctaaggttccccgggttaccccgttttacccccccggtacggggtccccctaaccccccgttaccccgttaccccgaaccggtaccggtacccttaaccccccggg

SEQ ID NO: 43881 - DNA, 635 bp, Homo sapiens
  misc_feature: GYAE6OF02GAI1N.31.14.B03.1.454.CMB.1.raw
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacgggccccaggcgaagggactgggaggtgggtggctatttanactaatttgatggagaattaaaaattttacgnagactcgtgaacgggccgattcacctatctccagacgacccttaccaaccatacnctgtatctaccaatgaactatggtgactagttagaagacacggactaacttattatgtgacgtaaagtagttcggttggttacgagctatacaagtgtaggtagttaggggtgtctcgactaccggtggggaccgaagggactacgtggtaccgaccgttctcctcgacgtaccctaccgacccgaacgggtcccctaacggttccccgggttacccctttcccccggtacggtacccctaccccccgttacccgtacccgaaccggtacccgcccgttaaccccgg

SEQ ID NO: 43882 - DNA, 816 bp, Homo sapiens
  misc_feature: GYAE6OF02HDCHC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtccgccgacggcccccgagggacgaaacggggactgggaggtggggtcggactattttataactaatttttagtaggtaagtaaagttaaaaaacttttaacggtacaacgaccgttaccggtaggaacggggccgtactttacaaccctacttccgtaccaacggaccgtaccccttacccaaacctactaccgcgtgttaactacctacctaaatagaaactagtggtagaacctaggttacgaaacgacgaccgggtaactaaacgtttagtttagtttagtacggtacgtaaacggtacgtttacggtttagggttacggaacgtaccgtaacgtactaagttacgggtagggtaaggttacggggtgggtaccgtacggaccggtaaccggtccgggggtaccgaacggggaaccctacgttcggggttacccgtaacccggttccgttcccgtacgtaaccgtaccccgtacccgtaaccccgggtaaccggggaccccgtaaccggttcccgggttacccccgtttccccgtaacccgggtcccttaacccccgtcccttacccggaacggtacccgtacccgtacccggttccggg

SEQ ID NO: 43883 - DNA, 655 bp, Homo sapiens
  misc_feature: GYAE6OF02JOALE.31.14.B03.1.454.CMB.1.raw
  modified_base (87)..(87): a, c, t, g, unknown or other
  misc_feature (87)..(87): n is a, c, g, or t
  modified_base (225)..(225): a, c, t, g, unknown or other
  misc_feature (225)..(225): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (441)..(441): a, c, t, g, unknown or other
  misc_feature (441)..(441): n is a, c, g, or t
  modified_base (520)..(520): a, c, t, g, unknown or other
  misc_feature (520)..(520): n is a, c, g, or t
  modified_base (588)..(588): a, c, t, g, unknown or other
  misc_feature (588)..(588): n is a, c, g, or t
tcagcagtagacgtcacgaccggtgctcgatttagtgtgagtagtttggggctgagcgtgggtttcctcgttgctctttaagaggtntccagtgtcaggtgcacctggtggaatcgtgggggagcgtggtccggccgtggggggtccctgagacctctccgtgtgccatggtctggcgtctgaattcatccctgaggtcacgtatcggcaatgcactcgggtccnccaggccccaggccaaggtctgggagtcgggtgacatttatactaagtttgagttggaagtaataaaaagtttcgactaagctccggtaggaagggcctaatccgacacttacctcgaggactacccttaccaacgtacacgtcngttaacncctaaccgaaattcgaactgtgggttacacgtagttacgaaaggtaccacggtacctaaatttntaacgttcgggacaccggtaaattcgtttcgttaggtacgagtaactagtacgtaagttcggagggttgtttaacgggngtaccgtacgtaccgtacgggcgggtaaccaaggtaccgtagttcgaccgtacgtccgactccggtancccgtaccgaccgaccgggacctagtccggtacctcccggatccacccgtctacgactacgcctcgg

SEQ ID NO: 43884 - DNA, 679 bp, Homo sapiens
  misc_feature: GYAE6OF02H95TS.31.14.B03.1.454.CMB.1.raw
  modified_base (260)..(260): a, c, t, g, unknown or other
  misc_feature (260)..(260): n is a, c, g, or t
  modified_base (605)..(605): a, c, t, g, unknown or other
  misc_feature (605)..(605): n is a, c, g, or t
  modified_base (643)..(643): a, c, t, g, unknown or other
  misc_feature (643)..(643): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcgtggggggtccctgagactctcctgtgccatgtctgcgtctgaattcatcctcgaggcactatggctatgcacgtgggtcccaccaggccccaggctaagggctgggagtgggtcgctattttanactaatttggataggagtaaacttaaaaaagttttcgacaagtacgttccggtaggaacgggccgtacttacacctatcctaccgacgactaccttaccaacctatacgactgtactacgtaccaaatcggaaactacgtggtacggtaactaggttaggaaacgcgaaacggacccttaaagtttagttaactttggtacgaacggtaaagtaggtttcgtttacgggtcgaagtcgtaaatcgaaagttggtaggtaaggttacggggtggtaccttacggaccaacccggttgggggaaccctaaggggactacggtgtaccgtaccgtcctacgtcgtacncctacccgaacgacggccctactcggtcccttaccccncggtaccctacccgtccacgtacgcctccgtaccgg

SEQ ID NO: 43885 - DNA, 565 bp, Homo sapiens
  misc_feature: GYAE6OF02GKOG0.31.14.B03.1.454.CMB.1.raw
  modified_base (188)..(188): a, c, t, g, unknown or other
  misc_feature (188)..(188): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (432)..(432): a, c, t, g, unknown or other
  misc_feature (432)..(432): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggggagcgtggtccggcctggggggtccctgagactctcctgtgccatgtctgcgtctgaattcatcctnaggcactatggcatgcacgtgggtccgccaggccccaggcaagggctggagtgggngcatttanactatttgatggagtaataaaaatttacgcagactccgtaggacggcgattcactatctaccagacgacccttccaaccactacgctgtactctaccaaatcgaacagtggtagactagttagaacgacacggactaacttattattgtagtacgtaaagtagtttcggttagtcgagtntaatatagtgtaggtagtgggtcgctcgacacggtgggacagggacngtcgctaccgtctcgtcacgcctcaccgacggcccattcccggtcctcccgtcggtccctacccgtccaccaacgtccgcctccgg

SEQ ID NO: 43886 - DNA, 910 bp, Homo sapiens
  misc_feature: GYAE6OF02G3X67.31.14.B03.1.454.CMB.1.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccacggccccaggcaagggactggagtgggngctagtttacactatttgagtaggaagtaaattaaaaaagttttacgactaacgacgttccggtaaggaacggggccgtaacttaccgaccaagtcctaccaaggtaaccgtacccctttacccaaaccctaattaaccggtcttacgttaacgtacctaaccctaaaattacggaaaacgtagttacgggtacgtaacgtaacggttaggaaaacggaaccgtaaaccgggtaccttaaaacctttacgttttaagtttacgggttacggaaccggtaaaaacggttacggttttaccggggtttttacgggtttaccggtaacgtaaccgtaacgttaaccgtaaaggtttacggtaggggttaaacggtttacgggggtacggtaccggttaaccggaaccggtaaaccccgggggttcgggggtaaacccgtaaacgggggggtaaaccctaccgggttacccgggttacccgttaaccccgtttacccgttccccgttaaccggtacccggtaaccccgttaccccgtaaccccgggaaaccccggggtcccttaaacccggttccccgggtttaaccccgttccccccggtaccggttcccctaaccccccgttaccccgttacccgaaaccggttaccggtaccccgtaccccggg

SEQ ID NO: 43887 - DNA, 906 bp, Homo sapiens
  misc_feature: GYAE6OF02H0Q5A.31.14.B03.1.454.CMB.1.raw
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcactcctcaggcactatggctatgcacgtcgggtccgccacggccccagggcaacgggctggagtggggngactatttanactatttgagtggagtaataaaaaacttttacgacagtactcgtagtaacgggccgtatccgaccatctaccacgacgtaccccttaccaacctacgtacgtactgtactactactaaactacgtaacctagtcggtagacgtagttacgaacgacgtaacgtaccgtaaatttacgtttaagttttaggtacggtaacgtaaaacgggttacgtttttccggggttttacgggtttacccggggtaaaggtacctaacgttaacgtaaacgggtttaggtttacggggtaaaggtttacggggggttacgggttacccgttaaccgggtaaccccgtacccgggggtttaccgggggggaaccccgggtaaaaccggggggttaaaccggtaacccgggtttaccggggttaccccgttaaaccccgggttttccccgttaccccggttaccggtaacccgtaccccccgttaacccggtaaccccggtaaacccggggggtaacccccttaacccgggtttacccccgggtttaaccccccttttcccccccgggtacccgggtacccccgtttaaccccccgtaccccccgggtttaaccccggaacccgttaacccggttacccccgttaacccccggggg

SEQ ID NO: 43888 - DNA, 700 bp, Homo sapiens
  misc_feature: GYAE6OF02J0YT3.31.14.B03.1.454.CMB.1.raw
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggccaagggactgggagtgggtggctagtttanactaatttgatggaagaattaaaaatttacgcagactccgtagaacgggccgattcactatctaccgagacgtacccttcaaccagtacgctagtactcctaacctaaagtcgaactacgtgggtacgaacgtagttacggaaacaccgaacggtacctaaactttagttagtttaggtagacggtaaagtagtttcggttagggttacgtagactacttacgtaagtggtacgggtaagtaggggtcgtaccgtacgtaacgtaccgggtgggtacccgtaagggtaactacggtcggtaccgtaccgttaccgtaccgtacgaccgtaccctacccgaaccgtaccggggtacccctacgttcccgggttacccctttcccccgacggtacccttacccccgtacctaacccggaacgtaccgtacccgtaaccccggg

SEQ ID NO: 43889 - DNA, 669 bp, Homo sapiens
  misc_feature: GYAE6OF02I45ZT.31.14.B03.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggctgagcgtggtttcctcgttggctctttaagaggtgtccagtgtcaggtgcacctggtggaatctgggggaggcgtggtccggcctggggggtccctgagactctcctgtgccatgtctgcgtctgaattcatcctcaggctactgtggcatgcncgtcgggtccaccgnggccccaggcgaagggtctgggagtgggtgcttattatactatttgagtggataattaaaaatttacganagtactccgtaggacgggactacttacacctatcctacgacgaccgtaccctaccaaccgatccgctacgtactctactaacagtaacagtggtanacgtagttagaacgtacgacggactaatttattgttagtgtaacgtaagttacgttcgggttaggttacgacgtataattaaggtaggtaggtaggttaggggtcggttacgtaccggtaccgtaccgggtcgggacgtacgggtaaccgtacggtacgtccgtaccgttccgttccgtacgtaccgtacccgtacccgtaccgaaccggtccctaacggttcccgtacccgtccccgtcgtaccctacccgtccgtaccgacgtccgtaccgtccggtcggg

SEQ ID NO: 43890 - DNA, 736 bp, Homo sapiens
  misc_feature: GYAE6OF02FFXN7.31.14.B03.1.454.CMB.1.raw
  modified_base (493)..(493): a, c, t, g, unknown or other
  misc_feature (493)..(493): n is a, c, g, or t
  modified_base (684)..(684): a, c, t, g, unknown or other
  misc_feature (684)..(684): n is a, c, g, or t
  modified_base (698)..(698): a, c, t, g, unknown or other
  misc_feature (698)..(698): n is a, c, g, or t
tcagcagtagacgtcacgaccggtgctcgatttagtgtgagtagtttgggctgagctgggtttcctcgttgctctttaagaggtgtccagtgtcaggtgcacctggtggaatcgtggggagcgtggtcccggccgtcgggggtccctgacgactctcctgtcgccatcggtctgaccgtctagtaacttcactccctacgacggtcctaacgtagtcggactacgtcggcctacggtccggtacccgccgaccggacccgtaggacggtaaacgggtcgtagggtagggtgggtaccggtacttaacgtttaacgttaaccgttaagttttacgaaggtaacggtaaaacgtttaaaaaccgttttaaaaccgttccgaccgtaacggtacccggttaccggtaacgggaccggtacctacgttacccaccgtaactccgtaacgacgtacccgtacctaccaacgtacgtctactactacgtacaacgtaanacgtaatgtcgacgtacgtagtaacgacacgtacgtactacttagttacgtacgtagtaaccgtgtcgttcggtacgtaggatcgattacgaggtcggtaggtcgaggtcgcccagtaccggtacggacggtacacgggtactcgtaccgtcctcgtccctcgacgtcccgaccgacgtacgcccggttcnccgtcccgttcccncgacctaccctcgtaaccacgaccgtccgtgtacccgg

SEQ ID NO: 43891 - DNA, 592 bp, Homo sapiens
  misc_feature: GYAE6OF02GZ1ZW.31.14.B03.1.454.CMB.1.raw
  modified_base (418)..(418): a, c, t, g, unknown or other
  misc_feature (418)..(418): n is a, c, g, or t
  modified_base (482)..(482): a, c, t, g, unknown or other
  misc_feature (482)..(482): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccagggcaagggactgggaggtgggtggctatttatacaatttgatggagaataaaaattttacgcagtactccgtgaagggccgattcaccatctccagacgaccccttaccaaccactaccgctgtactcctaccaaatgaacatggtagactagttagaacgacacggactaacttattattgtgacgaaagtnttcggttggtcgagctatacaatggtaggagttagggtgctcgactcggtggggccaagggacncgtcggtaccaccgtctcctagaccgccctaccaaccgacgggcccctagtcccggttcccttcccccgnggtcccctacccgtccctacccgaacgccgtcctacccgg

SEQ ID NO: 43892 - DNA, 629 bp, Homo sapiens
  misc_feature: GYAE6OF02JBZAR.31.14.B03.1.454.CMB.1.raw
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtaccgccaggcccccaggcaaagggacctgggagtgggtggctagtttatacaatttgatgganataaaaattttacgcagactcgtagaaggccattcacctanctcagacgaccttaccaaccntaacgctagtactctacaatacaacatggtanacagttgaacgacacgactaacttattatcgtgacgaaagtattaccgttggtccagtctactactaatgtaggagtacggtggacgtacgactacggtacgggacggaacgggaccgtacgtacggtaccgtacccgtaccgtcctacgcgtaccctacccaaccggaaccgggtccccgtaagttacccggttcccctttaccccggttccgcccgtaacccctccccgtaacccgtacgtaaccggccccgtacccgg

SEQ ID NO: 43893 - DNA, 693 bp, Homo sapiens
  misc_feature: GYAE6OF02I67YM.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccncaggccccaggcaagggctggagtgggtgctatttanacaatttgatggagaattaaaaaatttacgacagactccgtagaggccattcaccatctcagacgacccttccaaccatacgctgtactctacaaatgaacatggtgaacagttagaaagacgaacggacaaactttaattagtttgtagacggaaaagtgtttacggtttgggttacgagtctatacaagttggtagggaagttaggggttcggcgttacgaacctaccggttacggggaccaacgggggaaccacgttagggtacctaacccggttcttacccgtcgaaccgtccccgttacccgaacccgtaaaccggggtaccccctaacggttaccccgggttaccccctttaccccccccggttagggtacccccctaacccccgtttcccccgtaaccccggtaaacggacccggtaccccgttaacccccggg

SEQ ID NO: 43894 - DNA, 772 bp, Homo sapiens
  misc_feature: GYAE6OF02H66BX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggcgtggggggtccctgagactctcctgtcgccatgtctgcgtctgaattcatcctcaggcactagtggcagtgcacgtcgggtccgaccgacggccccgaggcgaaaggcgtagggtaggtggggtcgtactaagttttagaacttaagtttggagtaggaataaaattaaaaaagttttcgacgagtaacgtccggtaggtaaacggggacctaattacccaaccgtaacgttccaccgaacggtaccctaaccccttacccaaaccgtacgtaacgtccgttaacgtacctacgtaaccgtaaagtaacgtaacgagtttcggacaacgtacgtagaacggtacacgtactaacttagtatcggtagacgaagttagttcggttgtacgagtacgtactacgtagtaggtacggaaggttcgggtcgacgtaccgttaacggcccgggtacggggtaacgacggggtaaacctaggttccgggaaccgttccccgtttaccgcgtttaacccgaccgttccccgtaccccggtaaccggtaaccggtcccgttaccggttcccggtttacccccgtaaccccggtcggtaccctaaccccgtaaccccgttcgggaaacgccggtaaccctcccggg

SEQ ID NO: 43895 - DNA, 835 bp, Homo sapiens
  misc_feature: GYAE6OF02GQLN0.31.14.B03.1.454.CMB.1.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggagcgtggtccggccgtgggggtccctgagactctcctgtgccatgtctgcgtctgaattcatcctcgaggcactagtggctatgcacgtcgggtcccnccgacggccccgaggccgaaagggctgggaggtgggtcgctaatttanaactaagtttgagtaggaagtaaaattaaaaaacgtttcgactaagtaccgtccggtaaggaacggtccgtacttaccaaccgtacttcctaccgaacgacccgtaacccctttacccaaaccgtacgtaaccgtcttacgtaacttacccgtaacctaaaagtacgaaacgtaggttacggtacgaaacgttaggttaaacgaaacgaacgtaaccggtaacctttaaacgttttagttaacgttttaggaacggtaaaccgtaaaaggtttacgtttttaccgggtttaggtaccgggaaatcctaaagttaaccgttaaggtgggttaagggtacggttaacggggggtctacggtaccgtaaccggtaccgggtacgggaaccgtaaaggggtaacccctagggttacccggtaccctaccgtttacctccggtaaccaccggttaccccacccggaacccggtaacccgggtccccttaacggtttcccccgggttaaccccctccccggtaccgtaccccgtaccccgttaccgaccgttaaccgacgtcccgtaacccggg

SEQ ID NO: 43896 - DNA, 756 bp, Homo sapiens
  misc_feature: GYAE6OF02IJ2XJ.31.14.B03.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatccctnaggcactatggcatgcacgtgggtcccgaccacgggccccaggaccgaaagggtctgggaaggtgggtggactaattttanactaaatttgaagtaggaagtaaattaaaaaacttttacgacaacgaacgtccggtaggaagggcccgtattcaaccattacnccaagtaccgaaccccttaccaaaccactaccgctacgtactacctaccaaaatacgaaactagtgggtagaccgtaggttacgaaacgaccaacggtaactaaactttataagtttcggtagaacggtaaagtaagtttccgggttaggtttacgagactaaacttacgaaagttaggttagggaacgtttaggggtcgtcgtaccggaacgaaccggttgggggaaccctaagggaaccgaacgttccgggtacgaaccccgttcctacccgtaccgaggtccccctaccgaaacccggtaaccgggcccttaaccgttcccgggttaccccttacccccggtacgaccccggtccccctaaccgttaaccccggaaagttacccggacccgtaacccgg

SEQ ID NO: 43897 - DNA, 560 bp, Homo sapiens
  misc_feature: GYAE6OF02IOKTJ.31.14.B03.1.454.CMB.1.raw
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (530)..(530): a, c, t, g, unknown or other
  misc_feature (530)..(530): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccagggcaagggctgggagtgggtggctatttatacaatttgatggagtaaattaaaaaattttacgcagactccgtgaagggccgattcaccatctccagacgacccttccaaccatacgctgtatctaccaaatcgaacatggtagactagttgaaagacgacgataactttattatttgtagtagaaagtatttggttaggttcgagtcatacaatggtaggagtagggtgctcgacncggtgggccaggacactggtcaccgtctccncacgcctccacgacggcccacgtccgtccttccccnggcccaccctccaccgaacgcactacccgg

SEQ ID NO: 43898 - DNA, 608 bp, Homo sapiens
  misc_feature: GYAE6OF02JYTJD.31.14.B03.1.454.CMB.1.raw
  modified_base (213)..(213): a, c, t, g, unknown or other
  misc_feature (213)..(213): n is a, c, g, or t
  modified_base (484)..(484): a, c, t, g, unknown or other
  misc_feature (484)..(484): n is a, c, g, or t
  modified_base (576)..(576): a, c, t, g, unknown or other
  misc_feature (576)..(576): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggccaagggactggagtgggtggctatttatacatttgatggagaataaaatttcgcagtactcgtgaggccattcacatctacagacgacccttccaacctatacgctagtactcctaccaaatacgaacatgggtacaacgtagttagaaacgacgtaacggtactaactttattattaggtacgacgtaaagtactttacggttggttacgagtctaattactaagtggtaggtaagtaggggtcgactacggtaacnccgggtaggggaccaagggacctacgtcggtacctaccgtctaccgtcacgaccctacgaccgtacggccctagtcccgttaccctccccgngccctaccctcctaccgaacgacgcctaccgg

SEQ ID NO: 43899 - DNA, 606 bp, Homo sapiens
  misc_feature: GYAE6OF02FPO6G.31.14.B03.1.454.CMB.1.raw
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgaggactctcctgtgccatgtctgcgtctgaattcatcctcaggcactatggcatgcactgggtccgccaggccccaggcaagggactggagtgggtgcatttanacatttgatggagaataaaaatttacgctagactccgtagaagggtccgattcaccatctccagacgaccccttcaaccatacgctagtactctaccaaatcgaaacagtggtgaactagttgaagactacggactaacgttattattgtgacgtaaagatttcggttggttacgagtctatctaagtgtaggaagtgggtcggcgtcgacacccggtggggaccgacgggaactacgtcggtactacccgtctaccgtacacgtcctacccgaaccgaccgggtcccaacgttccggtcccttcccccgtacggtccctacccctccgtacctaacggaccgtcctacccgg

SEQ ID NO: 43900 - DNA, 675 bp, Homo sapiens
  misc_feature: GYAE6OF02JIANC.31.14.B03.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
tcagcagtagacgtcacgaccggtgctcgatttagtgtgagtagtttgggcgtgagctgggttttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcactggggtccgccagggccccaggccaagggctgggagtgggtgcatttanacatttgatggagataaaaatttcgcagacctcgtgaaggccattcacatcnccagacacccttccaaccatacgctgtactctaccaaatgaacattaggtnactagtcgaagacacggtacaacttattatgtgacgtaaagtagtttcgttagggttcgatcgaatacgaagttacgggtaggtaagttaggggtacggtaccgtacgtaaccgtaccccggttggggggtaacccaaggggggtaaacctaccggggttacggttacccgtacccgggttacccttaccccgtaccgaccgtaccccttcccgaaacccggtaaccggggtcccctaaccgttcccgggttaccccttcccccgttccggccctaacccccgttcccgtaccgaaccggtacgacccctacccggg

SEQ ID NO: 43901 - DNA, 570 bp, Homo sapiens
  misc_feature: GYAE6OF02F4M7V.31.14.B03.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcactgggtccnccacggccccaggcaagggctgggagtgggtgctatttanacatttgatggagaattaaaaatttacgactagactcgtagaacggcgtatacaccatctcagacgtaccctaccaaccatacgctgtatctaccaaatacgaactagtgtagacgagttagaagaacacgactaacttattatgtagacgtaaagtnttcggttggttcgagacatacaagtggtaggagtagggtcgtctacgacaccggtagggaccgagggaccacgtggtccaccgtcctactcgacgtcctaccgaccgaacggccctagtccgtccttcccgcgtccacccgtccacgacgcgcctaccg

SEQ ID NO: 43902 - DNA, 710 bp, Homo sapiens
  misc_feature: GYAE6OF02JBSR3.31.14.B03.1.454.CMB.1.raw
  modified_base (216)..(216): a, c, t, g, unknown or other
  misc_feature (216)..(216): n is a, c, g, or t
  modified_base (579)..(579): a, c, t, g, unknown or other
  misc_feature (579)..(579): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcagtgcacgtgggtcccnccacgggcccccagggcgaaggggactgggaggtggggtggactaatttactaactaatttgagttgggaataaattaaaaattttaccgacagacctcggtaggaacggggcctattccacctactccgtaccacgtacgtacccccttaccaaccataccgcttacgtactacctaccaaattcgaaactagtggtcgaacgtaggttagaacgacgtaacggtactaaacttatttagttgtagaaccgaaagttctttcggttacgggttacgagtcctaagttacaacggtggttagggtaacggttaggggtcgtacctaccggaccgtaccgggtacggggaccgaacgggtaacncgttacggtcccaccgttctcccgtcacgtcccctaccgaccggtaccggcccttaccgttccggttccccctacccggtcggtaccccctaccccttacccgtacccgaacgaccgtcccgttaacccgg

SEQ ID NO: 43903 - DNA, 807 bp, Homo sapiens
  misc_feature: GYAE6OF02FHFJQ.31.14.B03.1.454.CMB.1.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
tcagcagtagacgtcacgaccggtgctcgatttagtgtgagtagtttgggctgagctgggttttcctcgttgctcctttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccnccgacggccccgaggcgaacgggtacctggagtgggtggctagtttanactaatttgatggataataaaaactttcgctagactccgagacgggccattacaccatacncaagtacgacccttaccaacctactacgctgtactctacctaaactgaactagtggtacgacgtaagtttacggaacgtaccgtaaccgggtaccttaaacgtttagttaacgtttacggtacggtaaaccgtaaaaggtacgttttaccgggtttacgggtttaaccggtaacggtacctaacgttaacccgtaaagtacgggttacgggtaagtacgggggttacgggtaccgtccggtaacccgtaccggttacggggggacccgaacgggtaaacctacgttaccgggtacccgtaaacccggtccttacccgtaccgtacccgtaccccgttacccgaaaccccggtaaccgggtaccccccgtaaggttacccccgggtttaccccctttaccccccggtaaccggttacccccgttaccccccgttaaccccgttaacccgaacccggtaccggtaccccccgttaacccccgggg

SEQ ID NO: 43904 - DNA, 768 bp, Homo sapiens
  misc_feature: GYAE6OF02H84Z9.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatccctcaggcactatggcatgcacgtcggggtccnccaacggccccaggcgaagggactgggaggtgggtgactatttatactaatttgagtaggaagtaaattaaaaagttttacgacagtacgtaccggtaggaacgggtccgtaattacccaacctattccgtaccgaagaccgtaaccccttaccaaaccgtacttaccgacttacgtactacctaacctaaatcgaactagtggtagaacgtagttaggaacgacaacggtactaactttaatttagtttacggtaggtaacgtaaaggttacgttttaccgggtttagggttaccgaagtacgtacgtaacgtaagttggtaggggttaagttagggggtcgtaccgttacggaccgaccggtcggggaaccgaaggggtacctacggttcggtacccgtaccgttcctccgtacgaccgtaccctacccgaacccggtaaccgggtcccctacggtttccccggttacccccgtttcccccggtacccggtaccccttaacccccgttacccggtaaccccgaaggtaccccgacccgtaaccccggg

SEQ ID NO: 43905 - DNA, 579 bp, Homo sapiens
  misc_feature: GYAE6OF02GZY2Z.31.14.B03.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccaggccccaggcaagggctggagtgggtggcatttanacaatttgatgganaattaaaaactttcgacagtactccgtgaacgggccattcaccatctccagacgtacccttaccaaccatacgctgtactcctaccaaatcgaactatgggtcgacagttggaacgacgacgactaactttattatgtagacgtaaagtntttcgttggttcgancgatcaagtgtggagtagggtgccgtcgacnccggtgggaccgagggacacgtcggtaccaccgtctcctcgacgtccctaccaccgacggccctagttcccgtccttcccccgngccctacccgtcctaccgaagccgtcctacccg

SEQ ID NO: 43906 - DNA, 849 bp, Homo sapiens
  misc_feature: GYAE6OF02HC1X2.31.14.B03.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccaggccccaggcaagggactgggagtgggtgctatttanactaattgatgganaattaaaaatttcgacagactcgtgaggccattcacatctcagacgacccttaccaacatacgctagtactcctaccaaattacgaactagtgggtacgaacgtaaggttacggaaacgtaccgaaccgggtactaaaccttttaattttaagttttacggttaggaaccggtaaaaaggttacgtttttaccgggttttacgggtttacccggaagtaccgtaattaccgtaaaagtttcggggttaagggtaaggtttacggggggttcgggtaccgttacccgggaaccgtaccccgggttcgggggggaacccgtaaacggggggtaaacccgtaaccgggtttcgggttaaccccgtaccccggtttaccccgttccccgttacccggaaccggttaccccccttaccccgaaacccccgggtaacccggggggtaccccccttaaccgggtttaccccccggggtttaccccccgttttaccccccccggtaccgggtacccccccttaaccccccggtttccccccgtaaccccggtaaaccgggtaccccggtaccccgttaaccccccggg

SEQ ID NO: 43907 - DNA, 916 bp, Homo sapiens
  misc_feature: GYAE6OF02HHBVS.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccgccacggccccaggccgaaggggactgggtaggtgggtggctaatttataactaatttgataggaagtaaattaaaaaacgttttcgactaacgtaccgtaccggtaggaacggggtcccgtaatttaccaacctaacgttcctacccgtaacggtaaccgtaacccccctttacccaaaccctaacgttaacccgtcttaggttaacttaccgttaacccaaaagttacggaaacctagttacgggtacgtaacctaaggtttaacggaaacgtaaccggaaccggtaaaccttaaaccttttaagttttaacgtttagggttacggtaacggttaaaaacggttacgtttttaccggggtttaacgggtttaccggtacggtaccttaacgttaaccgtaaaggttttgggttaagggttaacggtttacgggggttacggtaccgttacccggtaaacccgtacccggggttacggggggacccgtaaacgggggtaaccctacggttaccgggtaccccttaacccgggttcccttacccgtaccgtacccgaccccgttaccccgaaaccggtaacccggggtcccccttaacggttacccccgggtttcccccgtttacccccgggtaccggtacccccttacccccggtacccctaacccggtaacggtacccggtaccccttaccccgggg

SEQ ID NO: 43908 - DNA, 603 bp, Homo sapiens
  misc_feature: GYAE6OF02FZ3ZX.31.14.B03.1.454.CMB.1.raw
  modified_base (257)..(257): a, c, t, g, unknown or other
  misc_feature (257)..(257): n is a, c, g, or t
  modified_base (363)..(363): a, c, t, g, unknown or other
  misc_feature (363)..(363): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggggtccctgagactctcctgtgccatgtctgcgtctgaattcatcctcaggcactatggcatgcacgtgggtccgccacggccccaggcaagggactgggagtgggtgctatttanacaatttgatggagaataaaaatttacgacagactccgtagaagggcgattcacatctcagacgacccttccaaccatacgctgtactctaccaaatgaacatggngacagttagaagacacggactaacttattatgtagacgtaaagtatttcgttaggttcgagctatcaatgtaggagtagggtgcgtcgaccgaccgtcgggaccgagggaacgacgtcgggtactacccgttctaccgtagaccgcctacccaaccggtaacgggccccaacgttcccggttccctttcccccgcgggtacccctaccccgtccctacccgaacgtccgacctaccccgg

SEQ ID NO: 43909 - DNA, 761 bp, Homo sapiens
  misc_feature: GYAE6OF02JFTN0.31.14.B03.1.454.CMB.1.raw
tcagcagtagacgtcacgaccggtgctcgatttagtgtgagtagttcggttgggggagctacaacaggcaggcaggggcagcaagatggtgttgcagacccaggtcttcatttctctgttgctctggatctctggtgcctacggggacatcgtgatgacgactagttccagactccctggctgtgtctcgtgggcgagagggccaccatcaactgcaagtccagccagagttatttttactcgccctaccaactaaacaacgtactttacgtacttcggttaaccgtacacgacgaaaaggtaaccggaacgacgtaccttcccgtaaaaccttccgtacgaactttacgccgggtactttaccgttaaccccgggcggtaccgttacccggggttaccccgtaaaccggtccggttacccgtagttaccggacttacggtacgggttcgtacgggtacccggtacggtttcgtacggtactaccgtacctacgtaccgtagtccaacgtccgttacgacgaacggcgttaccgaaagtcggttacggtccggtacgtaaggttttattacggtgttacgtacggttactaaacgtttcttaacgtactttaccgttaagttacctttacgtttaccgggttaccgtacgggtaaccgtaacggggttaccggtacggtaaccgtaacggtaacgtaacggttaggtaacgtaccgtaacggtaccgtaccgttagtaccttcggtaccctaacttaccgg

SEQ ID NO: 43910 - DNA, 667 bp, Homo sapiens
  misc_feature: GYAE6OF02JZA5V.31.14.B03.1.454.CMB.1.raw
  modified_base (258)..(258): a, c, t, g, unknown or other
  misc_feature (258)..(258): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtgggtccgccacggccccaggccaagggctggaggtgggtcgctagtttanactaattgatggagaataaaaatttcgcagtactcggtagaacgggcctatcacatctacagacgtaccctcaaccatacgctagtactcctaccaaatcgaacngtggtanactagttagaacgacgtacggtactaacgtttatacgttgtacgacgtaaagtctttggttacggttacgaggtactatacgtaagtcggtaaggtagttacgggtcgtctacggaccgtaccggtacggggtacccaaacgggtaaccncgggttacggtaccctaaccgggttcccttaccctcgtaaccgtccccttacccggaccgtaacccgggccctacgttcccggttacccttcccccgacggtcccctaccccgtacccgtaccgaacggtacccacccttaacccgg

SEQ ID NO: 43911 - DNA, 572 bp, Homo sapiens
  misc_feature: GYAE6OF02HTNND.31.14.B03.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
  modified_base (547)..(547): a, c, t, g, unknown or other
  misc_feature (547)..(547): n is a, c, g, or t
  modified_base (565)..(565): a, c, t, g, unknown or other
  misc_feature (565)..(565): n is a, c, g, or t
tcagcagtagacgtcacgaccggtgctcgatttagtgtgagtagtttgggctgagcgtggtttcgtcgtgctctttaagaggtgtcagtgtcaggtgcacctggtaggaatcgtgggggagcgtggtccggcgtgggggtcctgagctctcctgtgccatgtctggctntanaattcntcctacgaggctactagtggctgtgacncgtgggccgcaacgggcccaggacgaaggnttgggacggtgggngactatttaccatattgagtgaagaaattaaaagtttacncgagtctacgnggaaggtccgatcactactcgacacgactacctccaacgtatccgnttcatacgtacaaatgaacagtgttagcgtagtacgagtacagactaaatttntaacgtttgagtagaagtagtttcgtgtacgntactgtacaagtcgngtagaggttnacgcgtacacggcggggtcaacggacacgtggcctcggtcctgcgtcgcctaccncggaaccgtccacgtcctcccgttcccaaccgtcncccgtacaccggaatccngacccgg

SEQ ID NO: 43912 - DNA, 825 bp, Homo sapiens
  misc_feature: GYAE6OF02IR7LO.31.14.B03.1.454.CMB.1.raw
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctgggggtccccagactctcctgtgccatgtctgcgtctgaattcatcctcaggcactatggcatgcacgtcgggtcccgccacggcccaggcgaacgggctgggagtggnggctatttanactaatttgagttggaacgtaaattaaaaaagttttaccgacaagtaaccgtcccggtagggtaaacggggcccggtaactttccaacccgtattaccgttaccgaacgtaaccggtaaccccctttacccaaacccgtaattaacccggcttacggttactacctaccctaaaaagtcgtaaaccgtaagttcgggtacgtaccgtaaggtttaggaaacgaaccgtaacgggaacttaaaacgtttagtttaagtttacggttaggaacggtaaacggtaacgttttaccgggtttagggttacggtagtaccgtaataccgtaaaggttcggtaggtagttaggggttcggtaccgttacgaccgtacccggtcggggaccgtaaacggggtaaacctacggtcggggtacctacccgttccgttacccgtacgtaccggtcccttaacccggacccgaaccggggtacccctaacggtttcccggttcccccgttccccggtacggtaccccctaccccgttcccgtaacccaaccggtaccgtacccgaacccgtcccggggg

SEQ ID NO: 43913 - DNA, 571 bp, Homo sapiens
  misc_feature: GYAE6OF02F35X9.31.14.B03.1.454.CMB.1.raw
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacgggcccccagggccaagggacctgggagtgggtgcatttatacaattttgatggagaattaaaaaattttacgcagactccgtagaagggccattcaccatcctccagacgaccccttccaaaccataccgctgtactctaccaaatgaaacatggtgaactagttagaaagacgaacggactaactttaattattgtagacgaaagtatttcggttggttcgagctatacaatggtggtaagtagggtgcttcgacaccggtggggaccagggacncgtggtacnccgtctcctnacgccnccacgacggccagttccgtccttccccgngccnccctccncagcnctccg

SEQ ID NO: 43914 - DNA, 716 bp, Homo sapiens
  misc_feature: GYAE6OF02GKYQM.31.14.B03.1.454.CMB.1.raw
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctagaattcatcctcaggcaactatggcagtgacacgtcgggtcccgaccgacgggcccccaggaccgaaagggcgtgggacggtggggtcgctaagtttacaactaatttgataggaataaattaaaaaattttcggctaagacttaccggtaggaacgggtcacttaccactatccgtacgaacgaccgtacccttacaacctataacgcgtactactccaactaatcgaactggtagtacgaactaaggtacgaaagtaccgacgttaactaactttaagttacgtacgtacggaaactaaacggttntttacgggttagttacggngtaactagtactaagtcgttaggaacgttacgggtacgtaccaccggtaaccgtacgggacggggtaccgaaacgggacttacggtcgtacccgtaccttcctacctcgaccgtccctaccgaaccggaccggtaccctacggttcccgtaccccgtttccccgacgtacccccgtccttaacccgtacgacggtacccgccgttacccggg

SEQ ID NO: 43915 - DNA, 608 bp, Homo sapiens
  misc_feature: GYAE6OF02IG53P.31.14.B03.1.454.CMB.1.raw
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (525)..(525): a, c, t, g, unknown or other
  misc_feature (525)..(525): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggcccccaggcaagggactgggagtgggtggctatttanacaatttgatggagaataaaaaattttacgnagactcgtagaagggccattcaccatctccagacacccttccaacatacgcttgtactctaccaaatcgaaacagttggtcgaactagttagaaagaccacgggactaaactttaatttagttgtagacgaaaagtagtttcggttggttcgagctaatctaaagtggtaggtagtaggggtggacctccggaccgtaccggtgggggccaaggggaacacgtggtccaccggttcncctccacgccctccaccggacgggcccacgtccggtccttcccccgtggcccctaccctccctaccaacgtacgcctacccgg

SEQ ID NO: 43916 - DNA, 626 bp, Homo sapiens
  misc_feature: GYAE6OF02FPZBZ.31.14.B03.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactgggagtgggtggctatttatactaatttgatgganaataaaaatttacgnagactcgtgaagggccattacaccatctaccagacgacccttaccaaccatacgctgtactctaccaaatgaacatggtanactagttgaacgacgacggactaactttagttattgtagtacgaaagtgtttcgggttggttacgagctatacaagtgtaggagtaggggtgccgtcgacctaccggtggggaccctaagggaacctcgtacggtaccgacctccgtcctaccgactccctacccaccggtaaccgggcccctagttccccggttacccttccccccgtacggtccctacccccttccccgtaccaaccggaccgtaccctaccccggg

SEQ ID NO: 43917 - DNA, 932 bp, Homo sapiens
  misc_feature: GYAE6OF02JON3F.31.14.B03.1.454.CMB.1.raw
tcagcagtagacgtcacgaccggtgctcgatttagtgtgagtagtttgggctgagctgggttttcctcgttgtctctttaagtaggtgtccagtgtcaggtgcacctggtggaatcgtgggggaggcggtgggtcccggccgtcggggggtcccgtgaggactctcctgtgccatgtctgcgtctgaattcatcctcaggcactatggcatgcacgtcgggtccgccacggccccagggcaagggactgggacggtggggtggctaagtttatactaagtttgagtggaacgtaaattaaaaaacgttttagacctagaaccttccggtaggaacgggtccgtataccacctatcctaccgaaggtaccgtaccccttaccaaaccgtactaccgacttcgtaactacctacctaaaacgtacgaaactagtacggacgtaacgtagttaacggaaagtaaccgaacggtaaccttaaacgttttaagtttaacgttttaggtaacggtaacggtaaaacgtttaaacggttttacgggttttaacgggtttaacgtaaacggttactaaacgttaacgttaaagttacgggttacgggtaagggtttaacggggttaccgggtaccgttaaccgggtaacccggtaacccgggtccggggggtaaacccggtaaacgggggtaaaccggttaacccgggttacgggtaacccgttaaccccgggtttccgtaccccgttaaccggtacccgtaccccggttaccccgtaaaccccgggtaaacccggggtccccccggttaaacgttccccgggttttaaccccccggtttcccccccggttaaccgggtacccccctttaaacccccccgggttcccccgttaaaccccggaaacccgggttaccccgtaacccggtttaaccccccggg

SEQ ID NO: 43918 - DNA, 710 bp, Homo sapiens
  misc_feature: GYAE6OF02F7WHT.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtcccnccgacggccccaggcgaagggctggaggtgggtgactattactactatttgataggaataaattaaaaaattttacgcaagtaccgtccggtaggaacgggccgtattccaacctatcctaccgacgtaccgtaccccttaccaacctagtaccgtctgtactacctaacaaacgtcgaaactagtaggtagtaactaggttacggaaacgaccgtaaccgggtaaccttaaacgtttaattttacgttcggttaacggtaacgtaaaacggttacggttttcggttacgggttacgtacgtactagtactaagttgggttaggtaaggttacgggttcgtactaccggaccgtaccggtcgggggaaccctagggaacctacggttcgtacccgtaccgtcctacccgtcgaccgtccctaccgaccgacggtccctacgtcccgttcccctcccgtcgtccctacccgtcctacgtacgacgtcctacccgg

SEQ ID NO: 43919 - DNA, 733 bp, Homo sapiens
  misc_feature: GYAE6OF02H43HJ.31.14.B03.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccnccaggcccccaggccgaagggctgggagtgggtgctatttanactaatttgatggaagtaataaaaaattttacgactagactccgtagaggccgtattccaccatctccagacgtacccttccaaccatacgctgtactctacctaaatcgaactataggtacgaacgtaagttaggaaaacgtaccgaaccgggaacctaaaccttttaagtttaatttaggttacgtaaccggtaaaagttgttttaacgggttttcgggtttacggtaacgtacgtaactactaaggtttaggttagggtagttacgggggttgtaccgtacgaaccgaccggtcgggggacccgaaggggaacctacgttcggtacctaacccgtcctaccgttacgaccgtcccttacccgaacccgtaacgggcccctaacggttccccggttacccctttacccccggtccggtaccccctacccccgttaccccgtacccgtaaacggtccgtaccccttaccccggg

SEQ ID NO: 43920 - DNA, 749 bp, Homo sapiens
  misc_feature: GYAE6OF02G1HRT.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggccccaggcaagggactggaggtgggtggctatttatactaatttgatggataattaaaaatttcgacagactccggtgaagggccgtattcacctatcttacagacgacccttaccaacctataccgctagtactacctaaccaaagtacgaactagttcggtacgacgtaggtacgaaacgaacgaacggtactaaacgttttaatttacgtttggttaagaaccgtaaaggttacgttttacgggtttaggtttaccggtaagtccgtaataaccgtaagttgggttacgggtaaaggtttagggggttcgtaccgttaccggtaaccgtaccgggtacggggggtacctaaacggggacctaccgggttcgggtaacccgttacccgttccgttaccctaaccgccgttaccccgttacccgaacccggtaaccgggcccttaccggttacccggtcccctttacccccggcgtaccccctaccccgttaccctaacccgtaaccgtaccgtccctaacccggg

SEQ ID NO: 43921 - DNA, 670 bp, Homo sapiens
  misc_feature: GYAE6OF02H85MO.31.14.B03.1.454.CMB.1.raw
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactagtggcatgcacgtgggtccgcaggccccaggcaagggactggaggtgggtgctatttanactatttgntggagtaataaaaatttcgnagctcgngaggcatcacatcncagactcccttaccgaacctatacgcttagtactcctacgaaatgaaaccgtagtggtanaacgtagttagaaacgtccgaaggtactaaacgtttattagtttacgtagtaacgtaaaggttacgttttacgggtttaggttacgacgtactacttacgtaaagttcgggtaacggtaggttagggtcgtaccgttacgaccgacccgggttggggacccaacggggactccggtggtaccctaccggtcctacccgtcgaccgtcccacccgtaccgggaaccgtcccgtaccgttcccggttccccttaccccgtcgaccccgtaccccgttacctacccgtaacggtaccgtcctacccggg

SEQ ID NO: 43922 - DNA, 815 bp, Homo sapiens
  misc_feature: GYAE6OF02HHWH9.31.14.B03.1.454.CMB.1.raw
  modified_base (176)..(176): a, c, t, g, unknown or other
  misc_feature (176)..(176): n is a, c, g, or t
  modified_base (261)..(261): a, c, t, g, unknown or other
  misc_feature (261)..(261): n is a, c, g, or t
tcagcagtagacgtcacgaccggtgctcgatttagtgtgagtagtttgggcgtgagctgggttttcctcgttgctcttttaagacggtgtccagtgtcaggtgcacctggtggaatcgtgggggagcgtggtccggcgtgggggtcctgagactctcctgtcgccatgtctgcgtntgaattcatcctcgaggcactagtggcagtgcacgtcgggtccgccgacggcccaggcaagggcgtggagtggtgctaagtttanactattagagtagtaagtaaattaaaaacgtttacgcaacgacgtaccggtaggtaacggtcgtattaccaaccgtataccgtaccgacgtaaccgaaccccgttaccgaaaccgtagtaccgtacgtacttaactacctaacgaaatacgtaaacgtagtacggtagacgtaagttacggaaacgtaacgaaccggtaacttaaacgtttaacgtttagttacggtaacgtaacgtaaaagtttcggtttacggtttaggttaacgtacgaacgttaagtaacgtaagtaggttaacggtaaggttacgggtcgtacccgttaacgaacccggtaccgggttacggggtacccgtaaagggtaacctaccggttaaccggtacccgtaacccggttcctaaccgtaccgtaaccgtacccgttaaccccggtaaccgtaacccgggtaaccccttacggtttaccccggttaccccgttcccccggttaaccggtacccccgtaccccgttaaccccgttaccgaaaccgggtttcccgacccgttaccccgg

SEQ ID NO: 43923 - DNA, 571 bp, Homo sapiens
  misc_feature: GYAE6OF02I5BWX.31.14.B03.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (403)..(403): a, c, t, g, unknown or other
  misc_feature (403)..(403): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctggggagcgtggtccggcctggggggtccctgagactctcctgtgccatgtctgcgtctgaattcatcctcaggcactatggcatgcactgggtccncaggccccaggcaagggactgggagtgggtgcatttanacaatttgatggagataaaaattttcgcagactccgtgaagggccgattcaccatctccagacgacccttaccaaccataccgctgtaactctaccaaattgaacagtggtgactagttgaagtacacggcaacttattattgtagcgaaagtnttcgttggttcagctatcaatgtaggatagggtcggctcggacaccgttggggacctagggaactacgtggtcaacggtcctcctacacgcctaccaccgaacgggtcccaattcgggtacccttccccgnggtccacccctccttaccgaagtaccgcctaacccgg

SEQ ID NO: 43924 - DNA, 707 bp, Homo sapiens
  misc_feature: GYAE6OF02JCX0N.31.14.B03.1.454.CMB.1.raw
  modified_base (208)..(208): a, c, t, g, unknown or other
  misc_feature (208)..(208): n is a, c, g, or t
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (586)..(586): a, c, t, g, unknown or other
  misc_feature (586)..(586): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcgtgggggtccctgagactctcctgtgccatgtctgcgtctagaattcatcctcaggcactatggcatgctacgngggtcccgccaaggccccaggccaaaggggtctaggggagtcgggtgcaattttacacaatttgagtgggataagttaaaaattttcgacgagactaccggtgaagggcccgattcaccntccgtccaagcgacccctacaacgatacgctcgtataccttcaaattcgaanacgtggtgtacaggttagaacggacaccggtactaaactttagttaattggtgaacgtaaaccgtagtttccgggtttaggtttacgagttccgattacgtaagtggttaggagttaggggtcggtccgttacgacccgaacgggttcggggacccggaagggtaaccgtaaccggtgggtacccgtaacgttcccgtcccgttanaccgggaccctacccgaacccggtaacggtccccgtaccggttcccggttccccgtttcccccgtaccgccccgtaaccccgttacccctaccgtaaacgggcccttaacgtacccccggg

SEQ ID NO: 43925 - DNA, 669 bp, Homo sapiens
  misc_feature: GYAE6OF02GPO73.31.14.B03.1.454.CMB.1.raw
  modified_base (384)..(384): a, c, t, g, unknown or other
  misc_feature (384)..(384): n is a, c, g, or t
tcagcagtagacgtcacgaccggtgctcgatttagtgtgagtagtttgggctggagctgggtttcctcgttgctctttaagaggtgtccagtgtacaggtgcgacctggtggaatctgggggagcgtggtccggcctgggggtccctgagactctcctgtgccatgtctgcgtctgaattcatcctcaggcactatggcatgcactgggtccgcccaggccccaagggcaacgggactgggagtgggtggctatttataacaattttggatggagaattaaaaacttttacgacagactccgtagtaacgggccgtattcaccatcttcccagacgtacccttccaaccgatacgctagtactctaccaaatgtaacatggtanacgagttgaaagacaacggtacaacttattattagtgacgtaaagtatttcggttaggttacgacggtacacgttactaaagtcggtagggtaattaggggtacggcttacggacctaccggttgggggcccaaggggaaaccgacgttagggtccttaaccggtcctacccgttccgaaccgttcccgtacccgacccgaacgggccccctaagttcccgggttacccttcccccgtaggccccgttacccgtccccgtaccaccggtaccgaccctaacccgg

SEQ ID NO: 43926 - DNA, 724 bp, Homo sapiens
  misc_feature: GYAE6OF02HH40M.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcactggggtccnccgacggtccccaggccgaagggtctgggagtgggtggctatttagtactaatttgagtggaagtaaattaaaaacgtttacgacaagtaccttaccggtaggaacggggtacccgtattaccacctactcctaccacgaaccgtaccccttacccaacctactaccgtctagtactcctaacctaaatacgaactagtggtgaacgtagttacgaagaacgacggtaactaacttattaagttgtacgtaacgtaagtagtttacggtttcggtacgtacgacgtaatacgtaagtggtaaggttaggttaaggggtcggtccgtacgaccgtccggacggggtaccgaacgggactacggttcgtaccggacccttcctcccgtacgtaccgcccgtacccgacccggtaaccgggtcccctaacggtttccccggtccccttaccccgtaccggtaccccttacccccgttccctaacccggacgtaccgtaccccgtacccggg

SEQ ID NO: 43927 - DNA, 601 bp, Homo sapiens
  misc_feature: GYAE6OF02HE4NM.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtggctatttatacaatttgatggagaattaaaaaattttacgcagactccgtgaagggccgattcacatctccagacgaccccttccaaccatacgctgtatctaccaaatcgaacatggtgacagttagaagacacggctaaacttattatttgtgacgaaagtatttcgtttggttcgagcatacaagtgtaggagttaggggtgcgtacgaccgaccggttggggacccgaggggaacctacgtggtaccacccgttcctccctcgacgtccctcccgaccgaacgggccccaacgttcccggttccccttcccccgtcggccctacccctccctaccgaacggacacctacccgg

SEQ ID NO: 43928 - DNA, 747 bp, Homo sapiens
  misc_feature: GYAE6OF02IZ6ZA.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgagactctcctgtgccatgtctgcgtctgaattcatcctnaggcactatggcatgctacgtgggtccnccacggccccaggcaagggctgggagtgggtgctagtttatactatttgagtggaagtaattaaaaacttttcgacagactcgtaggaggctattcacctatcctacgagacgacccttaccaacctataccgtctagtactctacaaagtgaacagtggtacgagtagttagaacgactacggtactaaacgtttaacttagttaggtacgtacgtaaaagttgtttaccgggtttaggtttcggaagtaccgtaagttaccgtaaagttcgggtaagggtaacggttacggggttacgccgttacccgtaaccggacccgggtcggggaacccgaaacggggtaacctaccgggttcggtaccgttaccccggttcttacccgtacgacccgtaccccttacccgaaacccggtaaccggggtccccctaacggtttcccgggttaccccccgttacccccggtaccggtacccccgttacccccgttacccgtaacccggaaacggttcccgtaccccgttaccccggg

SEQ ID NO: 43929 - DNA, 787 bp, Homo sapiens
  misc_feature: GYAE6OF02ID6OJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggccgccacggccccaggccaagggactgggaggtgggtgctatttatacaagtttgagtaggaagtaattaaaaaattttacgacaagtacctccggtaggaacggggcctaagttccaacctactcctaccgaggaaccgtaccccttacccaacctactaccggcttacgtactacctaccaaatcgaacgtataggtacgacgtaggtagaagacgtaccggactaactttaattagtttaggtacgacggtaaaagttacgttcggtttacgggttacgaacgtctaacgttactaaaggtttagggtacgggttaagtagggggttacggaccgttaccggtaaccggaacccgggttacggggaccgaacggggtaaactaccggtacgggtttaccgacccgggtttaccctccccgtaacgtaccgaccccgttacccgaaccccggtaacccggggtacccccttaccggttaccccgggtttccccgttacccccggttccggtacccccttacccccgttaccccgttaacccggaaaccggtaccggtaccccctaacccggg

SEQ ID NO: 43930 - DNA, 814 bp, Homo sapiens
  misc_feature: GYAE6OF02JQ371.31.14.B03.1.454.CMB.1.raw
tcagcagtagacgtcacgaccggtgctcgatttagtgtgagtagtttgggctgagctgggttttcctcgttgctcttttaagtaggtgtccagtgtcaggtgcacctggtggaatctgggggaggcgtggtccggccgtgggggtcccgtgagactctcctgtgccatgtctgcgtctgaattcatcctcaggcactatggcatcgcacgtcggggtccgcccacgggcccccaggggccaaagggggcctggggaggtggggtggctagtttataacctaagtttgagtggaagaaattaaaaaattttacggacaacgtactccggtaggaacgggaccggattcccgaactactctacctaggaccgtaccccttaaccgaacctacgtaaccgtcttacggtaactaccgttaacctaaaactacggtaaactaacgtagggtacaacctaaggttaacggtaaacgaacccgaaccgggtaactaaacctttaagttaagtttacgtagtaaccggtaaaaggtattttaccgggtttaagggttaccggtagtactacgtaacgtaatacgggtaggtaggttaacgggtcgggtaccgtacgggtaacctaccgggttcggggaccggtaaacggggtaacgtaccggtcgggttaaccctacccgggttccgtaccgtaccggtaccgacccttcccgaaacccggtacccggggaccgtaacccggttccggttaccccttaccccccgtcgggaccccttaccccgtacccgtacccgtaacggacccgtcccgtaaccccggg

SEQ ID NO: 43931 - DNA, 638 bp, Homo sapiens
  misc_feature: GYAE6OF02G0QU9.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccacggccccaggcaagggactgggagtgggtgctatttanactaatttgatggagaataaaaatttcgacagactccgtgaagggccgattcaaccatctccagacgacccttccaacatacgctgtatctacaaatcaacntggtnactagttagaacgacacggctaacttattattgtagacgtaaagtgtttacggttggttacgacgtnaactctaaagtggtaggtagttaggggtcggaccgttacgacgtaccggtcggggacccaacggggaacaccgtcggtccaacccggttcctaccctccgaccgtccctacccgaaccggaccggggtcccctaggttcccgggttcccttcccccgtcggtaccctacccccttcccgtacccgtaaacggaccgcccgtaaccccgg

SEQ ID NO: 43932 - DNA, 755 bp, Homo sapiens
  misc_feature: GYAE6OF02I2WTQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctagtaattcatcctcaggccactagtggcatcgcacgtcgggtcccgccgacggccccaggacaagggctgggaggtgggtgctatttatactaatttgagtggaagtaaattaaaaactttcgactaacgtaccgttccggtaggaacggtaccgtactccgaacctattcctaccgacggtaacctaccccttaccaaacctagtaccgtcttagtactacctaaccaaagtcgaaactagttagggtacaacgttaggttaacggaaacgtaaccgtaacgggtaaccttaaacgttttaagtttaagtttcgggttaacggacggttaaaagttacgttttaccgggtttacgggtacgacgtactaagtacgtaagtggttagggtaacggtggggtcgacgtaccgaaccgtaccgggtcggggtaccgtaacgggtacgtacgtcggtacctacccgttccgtacctcgaccgtaccctaccgaaccggaaccggtccctaacgttccccggtcccttacccccgtgtaccccctacccttaccgtacccgaaggtcccgaccctacccggg

SEQ ID NO: 43933 - DNA, 576 bp, Homo sapiens
  misc_feature: GYAE6OF02GEMKB.31.14.B03.1.454.CMB.1.raw
  modified_base (420)..(420): a, c, t, g, unknown or other
  misc_feature (420)..(420): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggccccaggcaagggctggagtgggtggctatttatacaatttgatggagaataaaaaattttcgacagactccggtagaacgggccattcaccatcctccgagacgacccttaccaaccatacgctgtactctaccaaatcgaacagtggtagacgtagttagaaagacacggactaactttattattgtagacgaaagtntttcggttggttcgagctatacaatgtagtagtagggtgctcgactaccgtgggaccagggaactcgtggtacaccgttcncctnacgtcctaccgaaccgacggccctagtccgtccttccccgngacccnccctccaccgaacgtcgcctaccg

SEQ ID NO: 43934 - DNA, 669 bp, Homo sapiens
  misc_feature: GYAE6OF02FX8RY.31.14.B03.1.454.CMB.1.raw
  modified_base (261)..(261): a, c, t, g, unknown or other
  misc_feature (261)..(261): n is a, c, g, or t
  modified_base (384)..(384): a, c, t, g, unknown or other
  misc_feature (384)..(384): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtcccgccacgggcccccaggcaaggggctgggagtgggtggctatttanactaatttgatggagaattaaaaaattttacgacagactccggtagaacgggccgtattcacctatcctaccagacgaccccttaccaaccatacgctgtactctaccaaatgaacagtggtnaacgtagttaggaacgaccgaacgggtacctaactttaagttatttggtagtacgtaaagtcgtttacggttaggtttcgaagtctatactaagtggtaggtaggtagggtcgtcgtacgaccgtaccgggtcggggaccgaacggggactacgttggtacccaccgttctcccgtctacgtccctaaccgaccggtaacggtcccgtacgttcccggtaccccttccccggtcggtaccccctaccccgttcccgacccgtaacggaccgtaccctaccccggg

SEQ ID NO: 43935 - DNA, 662 bp, Homo sapiens
  misc_feature: GYAE6OF02I1RLW.31.14.B03.1.454.CMB.1.raw
  modified_base (155)..(155): a, c, t, g, unknown or other
  misc_feature (155)..(155): n is a, c, g, or t
  modified_base (188)..(188): a, c, t, g, unknown or other
  misc_feature (188)..(188): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactntcctgtgccatgtctgcgtctgaattcatcctnaggcactatggcatgcacgtgggtccgccaggccccaggccaagggactgggagtgggtgctatttanactaatttgagtaggagtaattaaaaaattttcgacgaagacctaccggtagaacgggccgtattcaccgatctaccgacgacgaccccttaccgaacctactacgtctagtactcgtaccaaatagaacctagtggtagactagttagaacgacgacggtactaaacttattagtagtagtaacgtaaagtacgtttacggttggttacgagtactatactaacgtggtacggtaagtacgggtagaccgtacgaccgtacgggtcgggaccgaacgggaacctacgttagtccgtaccgttctcccgtacacgtccctaccgacgaacggccctaacgtcccggttacccttaccccgtggtacccctacccgtaccgtacccgaacggtcgtacccgtaccgg

SEQ ID NO: 43936 - DNA, 792 bp, Homo sapiens
  misc_feature: GYAE6OF02ID8WH.31.14.B03.1.454.CMB.1.raw
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccnccaggccccagggcaagggactgggagtggggtggctaatttanactaattttgatggaagtaattaaaaaagttttacgacagtactccggtaggaagggtccgtagttccaacctatacctaccgaaggaacgtaccccttacccgaaacctacgtaacgcgttaggtaacttacctaaccaaaacttagaaactacgttagggtacgaactaggtttaggaaacgacgaaccggactaacgttttaattaagtttggtacggaacgtaaaggttacgtttacggtttacgggtttacggagtacctaagttacctaaagttcggtaagggtaagttacgggggttcggtacgtaccggaaccgtaacccgtaggggggacccgtaaagggggtaaaccctaacggttacgggtaccctacccgggttacctacccgttaaccgaccgtacccctacccgtaaacccggaaccggggtcccctaacggttaccccggttccccgtttaccccccggtggtacccctaccccgttaccccgttaacccggaacggtaccggaccctaaccccggg

SEQ ID NO: 43937 - DNA, 678 bp, Homo sapiens
  misc_feature: GYAE6OF02I4ZJH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcagtgcacgtgggtccgccaggcccctggcgaaagggctgggacgtgggtcgactagtttacacgtatttgatggagaattaaaaagtttcgacagtactccgtagaacggccgtattcgacatcctacgagacgtacccttcgaacctataccgctgtactctaccaaagtacgtaacctagtcggtacgacgtacggttagaacgaccgaacggtactaacgtttattagttacgtacgaccgtaaaggttactttcgggttacggtcggaactcgtaataccgtaagttcggttagggtaagttaggggtaccgtacttccggtacgtaccgggtcgggtaccgtaacgggaacctacgtacgggttccaccgttctaccgtacgtaacgtccctaccgaacggaaccggtcctaaccggtcgtcccgttaccccgtcgaccctcccgtacctaccggaatccgtacctaacccgg

SEQ ID NO: 43938 - DNA, 773 bp, Homo sapiens
  misc_feature: GYAE6OF02JEAJT.31.14.B03.1.454.CMB.1.raw
  modified_base (212)..(212): a, c, t, g, unknown or other
  misc_feature (212)..(212): n is a, c, g, or t
  modified_base (725)..(725): a, c, t, g, unknown or other
  misc_feature (725)..(725): n is a, c, g, or t
tcagcagtagacgtcacgaccggtgctcgatttagtgtgagtagtttgggctgagctgggtttcctcgttgctctttaagtaggtgtccagtgtcaggtgcacctggtggaatctggggaggcgtggtccggctgggggtccctgagactctcctgtgccatgtctgcgtctgaattcatcctcaggcactatggcatgctactgggtcccnccaggccccaggtccaaagggtcctgggagtcggggtagcctaagtttatactaagtttgatagggaacgtaataaaaaagttttacggactaacgtacgtccggtaggaacgggaccgtacgttacaaccgtatccgtaccacggacgtaccccttaccgaaacctacgtaacgtctacgttataccctaccgtaaaacttacggaaacctaagttcgggtactaaccgtagttaacggaaagtaccctaacgggacttaaacgtttaatttagtttcggtaagggtacgtaaaacggttaacgtttacgggtttacgggtttaacccgagtaccgtaatttaccaaaggtttggtacgggtaagtttacgggggtacgtcgtaacgaccggtaccggtcgggggaaccctaaacggggaacctcgttacggtcaaccccgtttcgacccgttaccgacgtccctaccgtaaccgaacgggtcccctaagttcccgttacccgttacccccncggtaaccctacccgtcccgtaaccgtacgggtacctcccgttaaccg

SEQ ID NO: 43939 - DNA, 702 bp, Homo sapiens
  misc_feature: GYAE6OF02HG8XL.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccncacggccccaggcaagggactggagtgggtggctatttatacaatttgatggaagtaattaaaaaagttttacgcagactccgtgaagggccgattaccaccactctaccagaccgtaccccttaccaacctataccgctgtactcgtaccaaatcgaactagtaggtacgaactaggttagaaacgaccgaacggtactaaactttaattatttggtacgacgtaaagtacgtttcgggttaggttacggaacgtctaattacgtaaacgtggtagggtaacgttagggggtgtcctacggaccgtacccggttgggggacccgtaagggacctacgttcgggtaccctaaccggtttcctcccgtacaccgtccctacccgaaccgaacccgggtcccctaacggtttcccggtacccctttccccccggacggtacccccttacccccgtccctaacccgtaacggcccgtacccgttcccggg

SEQ ID NO: 43940 - DNA, 709 bp, Homo sapiens
  misc_feature: GYAE6OF02HLWFF.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccaggcaagggctgggagtgggtgctatttatactaatttgagtggaagtaattaaaaattttacgacagacgttccgtaggaacggggccgtattccaacctagtcctaccgaagacgtaccccttaccaaccactaccgctgtactacctaccaaatacgaactagttaggtacgtacgtagttacggaaagaccgaacggtactaaactttattagtttgtaggacgtaaagtcgtttacggttgggttacgaagtcgtaattacgtaagttggtagggtaaggttacggggtcgtccgtaccgggaaccgtaccgggtcgggggtaacccgaacggggtaacctacgggttcggtaccgtaccccgttccgtaccgccgtacgcccgttaccgaaccggaaccggtccctaacgttcccggttaccccttccccgcggttcccctaccccgttaccacccgaacgtaccgccgtaacccggg

SEQ ID NO: 43941 - DNA, 693 bp, Homo sapiens
  misc_feature: GYAE6OF02JHW8B.31.14.B03.1.454.CMB.1.raw
  modified_base (265)..(265): a, c, t, g, unknown or other
  misc_feature (265)..(265): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtccgaccacggccccagggccaaaggggactgggaggtgggtaggctagtttanacgtaagtttgagtaggaagtaaattaaaaaagtttaccgacgacgtaaccgtaccggtaggaaaccggggcctaacttaccgaacctagttacctaccacgaccgtaaccccttaccaaactactacgcttacgtactacctacaaatcgaacagttggtagactagtagaagacacgtactaacttagttatcgtacgtagaaagtcgtttacggttagtacgagtctatactaagtggtaggtaaggttacgggtnaccgtacgaccgtaccggtaggggaccgtaacgggaactacgtcggtacccgtacgttaccctcctacgaccgtaccctaccgaaccgaccggtccctaacgtcccgtttaccccgtaccccgtccgtacccctacccctacccgacgaacccgtcgtacccgtaccgg

SEQ ID NO: 43942 - DNA, 547 bp, Homo sapiens
  misc_feature: GYAE6OF02HO48C.31.14.B03.1.454.CMB.1.raw
  modified_base (315)..(315): a, c, t, g, unknown or other
  misc_feature (315)..(315): n is a, c, g, or t
  modified_base (477)..(477): a, c, t, g, unknown or other
  misc_feature (477)..(477): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttatacaatttgatggagataaaaaattttacgcagactccgtgaagggccattcaccatctccagngacccttccaaccatacgctgtatctccaaatgaacatggtgacagttgaagacaacggcaactttattattgtgcgaaagtattcggttgttcgagcatcaatgtggatagggtgtcgtcgacacctggggaccagggaacacgtggtcgacccgtctccncacgcctcccaccaacgggcccagttccggtcttcccccgngtccaccctccctaccgaacgacgcaccg

SEQ ID NO: 43943 - DNA, 662 bp, Homo sapiens
  misc_feature: GYAE6OF02FNVA6.31.14.B03.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggctgagcgtgggtttcctcgttgctctttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacgggccccaggcgaaagggctggaggtgggtggctatttatacaatttgagtggaagtaattaaaaaattttcgacaacggtacgtaccgtaggaacgggtccgtaattccaaccattcctccgaagacgtaccccttaccaaccatccnctgtactcctaccaaatgaaactgtggtgactaggttgaaagacacggactaaactttattacgttgtaggaacgtaaagtgtttcggttaggttcgagactatactaaagtggtacggtagtaggggttcggttaccgactaccgggtggggacctaggggaactaccggtaggttccaccgttacctcctcgacgtccctcgaaccgtaccgggaccctacggtcccggtttaccctcccccggttaggcccctaccccttccgtaccaacggccgtaccgttaccgtccggg

SEQ ID NO: 43944 - DNA, 718 bp, Homo sapiens
  misc_feature: GYAE6OF02HF2L7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtcccggcctggggggtccctggagactctccttgtgccatgtctgcgtctgaattcatcctcaggcactatggcagtgcacgtcgggtccgccgacggccccaggcgaagggctggagtgggtggctatttatactagtttgatggaagtaaattaaaaagtttcgactacgacgtccggtagaacgggccctattccaccgtatccgtaccgacgtacgtaccctaccaacctataccgtctagtactactaaccaagtacgaactagttaggtacaacgtaggttacgaaggaacacggtactaacttagttagttcgtagaacgaaagttacgtttacggttaggtaccggtagtactaagtacctaagttcggtaggttaacggttaggggttacgtccgtacggtaaccgtaccgggtacgggacccgtaaacgggtaccgtacggttacgggtaccgaccggttcctacccgtacgaccgtacccgtaccgaaccggtaccgggtaccctacggttcccggtccccttcccgtcggacccctcccggttacccaccggaacgtaccggtacccgtaccccggg

SEQ ID NO: 43945 - DNA, 911 bp, Homo sapiens
  misc_feature: GYAE6OF02H9757.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggctgggggtccctgagactctcctgtgccatgtctgcgtctgaattcatcctcaggcactatggcatgcacgtcgggtccnccgacggtccccagggaccgaagggacctgggagtcgggtaggacctagtttacaactaagttttgattggaagtaagttaaaaaagttttacgacacgtacgtaccggtaggaacgggtaccgtattccaaccgtacttacctccgaaggtaccggtaaaccccttacccgaaaccctaacgttaaccgccgttacgttaacgttaccttaaacctaaaacgttacgaaacctagttacgggtaacgtaacgtaaggtttaacgaaacggtaaccgaaccggtacttaaacgttttaacgttttaacgtttcggttaacgtaacggtaaaacggtttacgttttaccggttttacggggttaacccgtaggtaaccgtaacttaaccggtaaaggtttgggttaacgggttaaacggtttacgggggttaccgggttaccggtaacccggttaacccggtaacccgggttaacgggggtacccggtaaacggggaaaccgttaaccggttaccgggttacccgtaaacccgtttcccgtaccccgtaccgtaccgtaccccgttaacccgtaccggtaaacccgggacccgttaccgttacccgggttacccccgtttacccccggtacccggtaccccttaaccccccgttacccgttacccggaaacccggttccggtacccgttaaccccggg

SEQ ID NO: 43946 - DNA, 944 bp, Homo sapiens
  misc_feature: GYAE6OF02FYLUN.31.14.B03.1.454.CMB.1.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccacggccccaggcgaagggactggaggtgggtgctatttanactaatttgatggaagtaaattaaaaaattttacgactaagtaccgtccggtaggaacgggccgtaactttaccaacctacttaccgtaccgaacggtaaccgtaaccccctttaacccaaaccctacgttacccggtaccttacgttaacttacccgtaaccctaaaacgttacgaaaacctagttacgggttacgaacgtacggttaacggaaaacgtaaccgtaacccgggtaaccttaaacgttttaactttacgtttaggttacggtaacggtaaaacggttacgttttaccgggtttagggtttacgtaacggtacctaacgttacgtaaaggttcgggttaagggtaacgggtttagggggttacgggtcccgttaccgggaacccgttacccggggtaccgggggtaacccggtaaacgggggaacccgttaaccggttaccggggttaccccgtaaccccggtttccccgttaccccgtccggtaacccgttccccccgttaaccccggtaaccccggtaaacccgggggtacccccttaacccgggttttacccccgggtttcccccccgttttacccccccgggttaccccggtaacccccccgttacccccccggttaccccccgttaaacccccggtaaccgggtaaccccggttacccccgttaacccccgggg

SEQ ID NO: 43947 - DNA, 795 bp, Homo sapiens
  misc_feature: GYAE6OF02JIOE5.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccagggccaagggactgggacgtgggtgctatttagtactaatttgatggaagtaattaaaaattttcgcagtacctccggtagaagggcccgtaattccgaacctacttcctaccgaacggtacgtacccccttaccaacctataccggtacttcgtactacctaccaaacttagaaacctagttagggtacgaacgtacgttagaaacggtacaaccggtacctaaacgttatttatggtacgacgtaaagttacgtttaccggtttagggttacccgaagtctaaacgttacaaagtttcggtaagggtaagttacggggggttacggtaccgttacccgggtaaccgtaacccgggttcggggggaacccgtaacggggtaaaccgtaccggttacgggtacccgtaacccggttccgtaccccgtacgtacccgtaccccgtaccgaacccgggtaaccgggtccccctaaggttccccgggttacccctttaccccccggtacggtacccccgttacccccttcccgttaaccccggtaaacggtacccggtcccccgtaacccggg

SEQ ID NO: 43948 - DNA, 686 bp, Homo sapiens
  misc_feature: GYAE6OF02JM5VC.31.14.B03.1.454.CMB.1.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (450)..(450): a, c, t, g, unknown or other
  misc_feature (450)..(450): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctgagactctcctgtgccatgtctgcgtctgaattcatcctcgaggcactnggcatgcacgtgggccgccaggccccaggcaagggctggagtgggtgctattanactaatttgatggagtaataaaaatttacgctagactcgtagaaggccgatcacatcctcagacgtaccctaccaaccatacgctagtactcgtaccaaatacgaactacgttggacgtaaccaggttacggaaagacgtaacggtactaaaccgtttattagtttagtagacgtaaagtaggtttcgttgggtacganctaatactaagtggtaggtaagttgggtacggcctaccggtacgaccgggttaggggacccgtaaggggaacctaccggttcggtacctacccggttccttaccgtaccgtaaccgtcccgtacccgaacccggtaaccgggcccccttaacggtttacccgggttccccttacccccggtcggtaacccttcccccgttacccgtaccctaacgggtaccgtaccccctaccggg

SEQ ID NO: 43949 - DNA, 798 bp, Homo sapiens
  misc_feature: GYAE6OF02HTPKF.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgccacgtgggtccgccgaggccccgaggcgaagggactgggagtgggtggctatttanactatttgagtggaagtaattaaaaaagttttcgacgaagtaccttccggtaggaacggggtcccgtaatttaccaaccctattcctacccgaacggtaaccgtaaccccctttacccgaaacctacgttaacccggtccttacggttaacttacccttaaccctaaaagttacggaaacctagttgggtacgtacgtaaggtttacggaaacggtaccgaaccggtaacctaaactttagtttaagtttggtagaacggtaaagttacgttttcggtttaggttacggagtacaatctaagttggtaggttagttaggggtcggtactccggaacgtacccgggtaggggacccgaacggggaactacgggttccgggtaccctaacccggttcccttacccgtaccgtaccgtcccccctaccggaacccggtaacccgggtcccctaacggttccccgggttacccccgtttcccccgacggttaccccctacccccgtacccgtacccgaacggcccgtacccgtaaccccggg

SEQ ID NO: 43950 - DNA, 151 bp, Homo sapiens
  misc_feature: GYAE6OF02HR3BG.31.14.B03.1.454.CMB.1.raw
  modified_base (146)..(146): a, c, t, g, unknown or other
  misc_feature (146)..(146): n is a, c, g, or t
  modified_base (148)..(151): a, c, t, g, unknown or other
  misc_feature (148)..(151): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccngnnnn

SEQ ID NO: 43951 - DNA, 645 bp, Homo sapiens
  misc_feature: GYAE6OF02FXZMV.31.14.B03.1.454.CMB.1.raw
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
  modified_base (534)..(534): a, c, t, g, unknown or other
  misc_feature (534)..(534): n is a, c, g, or t
  modified_base (605)..(605): a, c, t, g, unknown or other
  misc_feature (605)..(605): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtccgccacgggccccagggccaagggactgggaggtggggtggctaatttanactagtttgagtaggagaattaaaaatttacgacagtacctccgtaggaacgggtcctattaccaaccatcctaccagacgtacccttaccaaccatacnctgtactctaccaaagtgaactatcgggtagaacgtaggttagaacggacaacggtactaactttaattagttgtagaacgtaaagtacgtttcggttagttcggaagtctaagtacagtaggttcggagtaggggtcgccgtcgactaccgggtgggccgaagggtacncgtggtacctaccgtctccgctacgccctacccgaccgaacgggtccccacgttccggtcccttccccggngtaccctacccccgtcaacccgacgtaccgccctacccgg

SEQ ID NO: 43952 - DNA, 812 bp, Homo sapiens
  misc_feature: GYAE6OF02FFMPD.31.14.B03.1.454.CMB.1.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggcaagggactggagtgggtggctaagtttanactaagtttgataggagtaattaaaaaatttcgacagacctccggtaggacgggccgtattccacctatcctaccgagaccgtacccctttaccaaacctatacgctacggtactcctacaaatcgaaactagttggtacgtacaggttacgaacggaaccgacggtacctaaactttagttttattcggtacgaacggtaaaagtacgttttccggttacgggtttccgaaggtcctaaagttaccgtaaacgttggggttaggtaaagggtttacgggggttacggtacccgttaccgggtaaccgtaaccccggggttaccgggggtaacccgaaacgggggttaaccctaaaccgggttccgggttaaccccgtaacccggttccctaacccgtccgtacccgtaccccgttaccccgaaacccgggttaacccgggaccccttaccgggtttaccccgggttaccccccgttttccccccggacggttaaccccccgtcccccgttaaccccgttaccccgaaaccgggttccgaccccgttaaccccggg

SEQ ID NO: 43953 - DNA, 856 bp, Homo sapiens
  misc_feature: GYAE6OF02GX1W9.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccgacggccccagggccaaagggggactgggaggtgggggtaggacctaagttttaacactaaattttggaagtagggaagtaaaatttaaaaaaacttttaccggacaaggtacctaccggttagggaacggggtaccgtactttaccaacctacttcccgtaccaacggaaccgtacccccgttaccaaaccctagtaaccgcttggtaactacctaacctaaaattacgaaactacggtacgggtagtaactagggtttaagaaacgaccaacggtactaaacgtttaatttagtggtacgaacggtaaagtttacgtttcggttttacggtacgtacgtacctaagttaccaaggttaggttacgggtagtttaacggggggtcgtaaccgttccgggtaaccgaacccgggttggggggtaaacccgtaacggggtaaacctaaccgggtttaccggtacccggttaccgttaaccccgttcccaaccggttaaccgcccgttaacccccgaacggtaaccccggggtcccttaaccggttccccggggtttcccccgtttacccccgacccgggtaccccctaacccccctttccccggtaaccgaaaccgggttaccgaccccgttaaccccggg

SEQ ID NO: 43954 - DNA, 763 bp, Homo sapiens
  misc_feature: GYAE6OF02I31LP.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtgggtccggccgtggggggtccctgagactctcctgtgccatgtctgcgtctgaattcatcctcaggcaactatggcatgcacgtcgggtccnccacggcccccaggcgaagggactggggacggtggggtcggctaagttttaactaacgtaagtttcggagtagggtaaagtaaatttaaaaaaagttttaccgacgtaacgtaaccttaccggtaggaacggggtaccgtacttaccgaaccctattccctaccgaacgaacctaccccgtaaccaaaccgtactacgtacttagtaactctaacctaaatcgaaactagtacgggtacaacgtaggttacgaaacgaccgtaaccggtacttaaactttagttagtttcggtaagtacggtaaaagtacggtttcggtttaggtacgagtcagttactaagttgggaggttaggtacgggttcggaccgttacgaaccgtaccgggtacggggacccgacggggtaacctacggtacggttaccaccgttccgtacgtaccgaccgtccctacccgaaccggaaccggtcctaaccggttcccgtaccttcccccggtagtcccctaacccgtaccgttaccgaaacgccgtcccgtaaccgg

SEQ ID NO: 43955 - DNA, 773 bp, Homo sapiens
  misc_feature: GYAE6OF02H0FVN.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccnccgacggccccagggaccgaaggggactgggagtgggtggctatttatactaagtttgatggaagaattaaaaaattttacgacaagtacctccgtaggaacgggccgattccaacctacttccgtaccacggaacgtaccccttaccaaacctaactaccgcttacgtaacttcctaaccaaaatcgaactagtcgggtagtacgtaaggttagaaacgaacgacggtactaaactttattagtttcgtacgtaacgtaagtacgtttcggtttacggttacgagtactagtactaagttaggtaggtaagggttagggtcgtaccgtaccgtaaccgaccgggttcggggaccggaagggtaacctaccggttcggtaacccgttacccggtcccttacccgtaccgacccgtaccccgttacccgaacccggtacccgggtaccccgtaccggttccccgggttacccccgtttaccccccggtaccggttacccccgtacccccgttaccccgtaacccggaaaccggttcccggtaccccttaaccccgggg

SEQ ID NO: 43956 - DNA, 702 bp, Homo sapiens
  misc_feature: GYAE6OF02GX9YN.31.14.B03.1.454.CMB.1.raw
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactagtggcatgcacgtcggggtcccgccgacggccccagggaccgaaggggactgggaggtggggtggactagtttataactagttttgatggagaattaaaaaattttcgcacgactccggtaggaagggccgagttcaccatctccagacgacccttaccaactatacgctgtatcctacaatacgaacngtggngactagttagaagacacggataacttattattgtgacgtaaagtacgtttcggttggtacgacgtctagtactaagtggttaggtaggtacggggtgtaccgtcgaaccgtaccggtgggacccggaaggggaaccctacgttcgggtacctacccggttcctacccgttccgaccggtccccttaccccgaaccggtaacccggggtaacccctaccggtttaccccgggttcccccttaccccccggtcgggtaaccccctaccccgttcccgtaaccccggaacggtacccggtccccgtaaccccggg

SEQ ID NO: 43957 - DNA, 664 bp, Homo sapiens
  misc_feature: GYAE6OF02ITLTO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccgaggcgaacgggactgggaggtggggtggctatttatacaatttgatggaagaattaaaaaatttacgacagactaccgtagaagggccgacttcaccatctccagacgtacccttaccaacctaataccgctcgtactctaccaaatacgaactatggtagaactagttagaacgacgacggactaactttaattattgtacgtacggtaaagtagtttacggttggttacggatctaatactaagttagggtagggtaagttagggggtacgtcgtacgacccgaccgtcgggggaccaagggaacctacgtacggtaccgtaccgttcctaccgtaccacgcccgtacccaaccggaacgggccctacgttcccggttcccttcccccgtagggccccctacccttcccgaccgtaacgtaccgaccctacccggg

SEQ ID NO: 43958 - DNA, 840 bp, Homo sapiens
  misc_feature: GYAE6OF02JMMLH.31.14.B03.1.454.CMB.1.raw
  modified_base (223)..(223): a, c, t, g, unknown or other
  misc_feature (223)..(223): n is a, c, g, or t
tcagcagtagacgtcacgaccggtgctcgatttagtgtgagtagtttgggcgtgagctgggttttcctcgttgcttcttttaagaggtgtccagtgtcaggtgcacctggtggaatcgtgggggagcgtggtccggccgtgggggtccctgagactctccgtgtgccatgtctgcgtctgaattcatcctcgaggcactagtcggcagtgctacgtgggtccnccgacgggccccagggacgaagggactgggacggttggggcggtactagttttactacttaagtttggaataggaaagttaaaacttaaaaaacgttttccgacgtaacgtaaccgttaccggtagggaaacgggtacccgtaattacccgaacctacgtaccgtaccgaacggtaaccgtaccccgtttaaccaaaccgtacgttaaccggtacgtttacgttaacgttacctaaacctaaacgttcgtaaaaccgtagttcgggttaacgaacgttaaggttaaacggaacgtaaaccggtaaccgggacctttaaaacttttacgtttagttacgggtagtaaaccggtaaagtttacgttacggtttacgggtaaccgaagttacgtaacttacggaaacgttggtaagggtaacggttacggggtcgaaccgttcgaaacgccgggttcggggaacgtaacgggtacctagggtaccgtcccgaccgttccgtaccttcgacgtaccctacccggaaccggtaaccggtccttacggttacccggtaccccttcccggtaccggaacccttaccccgttaccgaaccgtaacggtaccgtaccgtaacccgg

SEQ ID NO: 43959 - DNA, 710 bp, Homo sapiens
  misc_feature: GYAE6OF02IJZXS.31.14.B03.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctgagactctcctgtgccatgtctgcgtctgaattcatcctcaggcactagtggcatgacncgtgggtaccnccacggcccnggacaaggctggagtcgggtgctatttagtacatttgatggaacgtaattaaaaatttacgacagtactccgtagaggccgtatcacatctacagcacctcaactatacgctagtactctacaaatcgaactagtgtagactaggttagaaacgcgaacggtactaacgtttatttacgtagtacgtaacgtaaagttacgtttaacgggtttcgggtttacgaggtacctaagttacctaagttacggtaggttaacggtagggtacggtccgtacgtaccgtacccggttcggggaacccggaacgggaaaccgtaccggtacggtacccgttaccggtcccgttccgtacccgtaaccgtccctacccgaacccggtaaacccggggtccccgtaaccgttcccggttaaccccgttccccccgtacggtccccttaacccccttccgtaaccccgacggtacccgccggttaaccccg

SEQ ID NO: 43960 - DNA, 677 bp, Homo sapiens
  misc_feature: GYAE6OF02F63CE.31.14.B03.1.454.CMB.1.raw
  modified_base (212)..(212): a, c, t, g, unknown or other
  misc_feature (212)..(212): n is a, c, g, or t
  modified_base (336)..(336): a, c, t, g, unknown or other
  misc_feature (336)..(336): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccncaggccccaggcaagggctggagtgggtagctatttatacaatttgatggagtaattaaaaaagttttcgactagactccggtagaagggcgattcaacatctaccagacaccttcaaccatcntcgtatcctcaaatgaactgtgcgaactagttagaagaacacgacaaactttattatgtacgactaaagatttacggttggttacgagctagtacaatggtaggaacgtagggtcgtacgttcgaaccgtaccgtcggggtaccgaaggggtaacctacggtacggttaccgaaccggttccctacccgtttaccgacgtacccccttacccgaacccggtaaccgggggtaccccctaaggttccccggttacccctttaccccccggtaccggtaccccgttaccccccttaaccccgttaaccccggtaaccggtacccggtacccttaaccccgggg

SEQ ID NO: 43961 - DNA, 686 bp, Homo sapiens
  misc_feature: GYAE6OF02I3G9O.31.14.B03.1.454.CMB.1.raw
  modified_base (175)..(175): a, c, t, g, unknown or other
  misc_feature (175)..(175): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggctgagctgggttttcctcgttgcttctttaagaggtgtccagtgtcaggtgcacctggtggaatcgtgggggagcgtggtccggccgtgggggtccctgagactctcctgtgccatgtctgcgtntgattcatcctcgaggcactgcggcaatcgctacgtgggccaccacgggccccaggcgtaaagggctgggagtgggtgactagttttacactaagttgatggacgtaaataaaaatttcgctacgagtccgtaggaacgggtcctaattaccaccgtataccgtccgaacggtactaacccccttcccgaaaccgtacttacccgggactaccggtaataccctaaccgaaagttaccgaataacgtggtactaaccgtagttaacgaacgtaccaacggtactaacttaagttcgtgtacgtacgtaaagtgttcgttagtccgangtactagacgtntggtaggtacgtgggtcacgtaccgacggttacgggacgaaccgggacgtaccgtacgtccgtacgtcccgtcgtaaccgcgtacccgtacccaacggacccggtcccgtacgtcccggtaaccctcccggtacgtaccctaccggttccaccggtaatacccggcacccgg

SEQ ID NO: 43962 - DNA, 550 bp, Homo sapiens
  misc_feature: GYAE6OF02FGSS8.31.14.B03.1.454.CMB.1.raw
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (353)..(353): a, c, t, g, unknown or other
  misc_feature (353)..(353): n is a, c, g, or t
  modified_base (441)..(441): a, c, t, g, unknown or other
  misc_feature (441)..(441): n is a, c, g, or t
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtccnccaggccccaggcaagggctggngtgggtgctatttanacaatttgatggagataaaaatttacgcagactccgtgaagggccattcaccatctccagacgacccttcaaccatacgctgtatctccaaatgaacatggtnacagttagaagacacggactaacttattattgtagacgaaagtatttcgttggttcgagcatcaagtgtggagtagggtgcctcgacnccgtggggccagggaacacgtggtacctaccgtctccgtcacgccctcgaccaacgggcccagtccggtcccttccccgnggcccacccgtcctaccagacncctaccg

SEQ ID NO: 43963 - DNA, 611 bp, Homo sapiens
  misc_feature: GYAE6OF02FG16H.31.14.B03.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccnccaggccccaggcaagggctggagtgggtggcatttanacaatttgatggagataaaaatttcgcagactccgtgaacggccattcaccatctccagacgacccttccaaccatacgctcgtatctccaaatgaacntggtgacagttagaanacacggctaactttattactgtagtacgtaaagtntttacggttggttacgagctaagtcaaagtgtaggtacgtagggtgcctcgacgtaccgtggggcccaaggggaccacgttcgggactacccgtctccgtacacgtccctacccgaaccgtaacgggccccaagttcccgggtccctttcccccccgtggtacccctaccccgttacccgtacccgtaacggccgtaccctaaccccggg

SEQ ID NO: 43964 - DNA, 667 bp, Homo sapiens
  misc_feature: GYAE6OF02G8421.31.14.B03.1.454.CMB.1.raw
  modified_base (255)..(255): a, c, t, g, unknown or other
  misc_feature (255)..(255): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccaggccccaggccaagggctggagtgggtgctatttanactaatttgatggagtaattaaaaaatttacgactaagtactccgtaggaacgggaccgtattcaacctatctaccagacgacccttaccaaccatacnctagtactctaccaatacgaacatggtagactagtagaagacgacgactaacttattaagttgtagacgtaaagtacgttacggttggtacggacacgtaatacgtaagttggtaggtaaggtacggggtgtacctcgaccgacggtacgggaccgaagggtaccacggttcggtaccgtacccgttctacccgtacgaccgtcccgtaccgaaccggaaccgggaccctaaccggttcccggtccccgttaccccccggtcggtacccctacccctacccgttacccgaacggtacccgtacccgtacccgg

SEQ ID NO: 43965 - DNA, 670 bp, Homo sapiens
  misc_feature: GYAE6OF02ISP2V.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccgccaggcccccaggcaagggactgggagtggggtgctatttacactaatttgatggagaataaaaattttacgcagactcgtgaacggccgattcacatctaccagacgacccttaccaaccatacgctgtactctaccaaatcgaacagtacggtagactaggttagaacgacgaacggtactaaactttatttacgtttgtacgtacgtaaaggttagtttcggtttcgggttacgagtactaagtactaagttggtaggtagtaggggtggtaccgtaccgacgtacccggtcgggggaaccgaacgggtaactacggtcggtacccgacccgttctacccgtccaccgtcccgtacccaacccggaacgggtcccctacggtcccggttcccttcccccggttcgaccccgttccccgtacccgtacccaacggtaccgacccgtacccgg

SEQ ID NO: 43966 - DNA, 755 bp, Homo sapiens
  misc_feature: GYAE6OF02IGX76.31.14.B03.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactgggtccnccaggccccaggcaagggctgggagtgggtgctatttatacaattttgaatggaagaattaaaaaattttacganaagactccgtagaagggccgattcaaccatctaccagacgtaccccttccaaccataccactgtatctaccaaatgaacatggtanacgtagttagaaagacacggactaacttattattgtagtacgaaagtagtttcggtttaggtacgtagacctattaccgtaagttaggtagggtaaggtttaacgggggtcggtacgttaacccgggaacctaacccgggtacggggggtaaccccgaaagggggtaaacctaaccgggtttacgggtacctaaccccgggttcccttaacccgtccgaacgttacccccgtaccccgaaacccggtaaacccggggccccctaaacggtttccccgggtttaaccccccgtttacccccccggttaccgggtaccccctaaccccccgtttaccccgttaaccccggaaacggtaccccgtaacccgttaaccccccgggg

SEQ ID NO: 43967 - DNA, 685 bp, Homo sapiens
  misc_feature: GYAE6OF02GAVIP.31.14.B03.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagcagtagacgtcacgaccggtgctcgatttagtgtgagtagtttgggctgagctgggtttcctcgttgctctttaagaggtgtccagtgtcaggtgcacctggtggaatctggggagcgtggtccggcctggggggtccctgagactcgtcctgtgccatgtctgcgtctgaattcatcctcaggcactatggcatgcactgggtccncctaggccccaggcaagggactggagtgggtgcatttanacgaattttgatggagtactaaaaagttttagactagtactccgtagaagggtccgagttcacctatccgtaccagacgaccctttccgaaaccacttaacgtctgtactcctaccaaatcgaactagtggtcgacaggttacgaaggtaccagggtacaaccgtttattaacttgttcgacgaaaaggtactttacggttggtttaccggagtcaagttaccaagttggtaggagttaggggttgccgttacgacgtaccgttacggggccaggggaccctaacgtcgggtaccaccgggttaccctccgtacgacggtccccgtaccctaccggtaaccggggtccccagttacccccggttccttaccccccgttagggacccctacccccggtttaccttacccggaaactacccggtacctaaccccggg

SEQ ID NO: 43968 - DNA, 613 bp, Homo sapiens
  misc_feature: GYAE6OF02G2QWK.31.14.B03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggctggagtgggtggctatttanacaatttgatggagaataaaaattttcgcagactccgtgaagggccattccaccatctccagacgacccttccaaccatacgctgtatctaccaaatgaacatcggtgaactagttgaagcacggactaacttattattgtagtacgaaagtagtttcggtttggtacgagtcatacaattggtggataggggttgcgttcgacaccggtgggccgaagggtacncgttggtccacccgtctccgtcacgtccctaccacccggaacgggtcccctaagttcccggttcccttacccccgttgggtaccccctacccccttcccgttaacccgaacggtaccgtaccgtaacccccggg

SEQ ID NO: 43969 - DNA, 671 bp, Homo sapiens
  misc_feature: GYAE6OF02JLKSF.31.14.B03.1.454.CMB.1.raw
  modified_base (276)..(276): a, c, t, g, unknown or other
  misc_feature (276)..(276): n is a, c, g, or t
  modified_base (442)..(442): a, c, t, g, unknown or other
  misc_feature (442)..(442): n is a, c, g, or t
  modified_base (618)..(618): a, c, t, g, unknown or other
  misc_feature (618)..(618): n is a, c, g, or t
  modified_base (648)..(648): a, c, t, g, unknown or other
  misc_feature (648)..(648): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (667)..(667): a, c, t, g, unknown or other
  misc_feature (667)..(667): n is a, c, g, or t
tcagcagtagacgtcacgaccggtgctcgatttagtgtgagtagtttgggctggagctgggttttcctcgttgctcttttaagaggtgtccagtgtcaggtgcacctggtggaatcgtggggagcgtggtccggccgtgggggtccctgagactctcctgtgccatgtctgcgtctgattcatcctacgaggcactatggctatgctacgtcgggtccgccgacggccccgtagggccaaaggggtacctgggacgttggggtcgctaagttttanactaattttgagttaggaacgtaaatttaaaaacgttttcgactaacggtaccttccggttaggaaacgggtcccttattacccgacctagtccgtaccgaggaccgtaccccttaccgaaaccattacgtcttagtaactctacctaaatacgaactagtaggtnaacgtgttacgaagaccgtacgtaactaacgttatttagttgacgtaccgtaaagttcgttacggtttacggtacgtacgactactagtaaactggtacggttagtaggtcgacgttaccgaacgtacgggtcgaccggtaacggaaccgtcgtacgtcccgtacgtcctccgacncgacctcgacgtacgctacgtctcctccgngacccnctccacgacncgntccg

SEQ ID NO: 43970 - DNA, 836 bp, Homo sapiens
  misc_feature: GYAE6OF02I87A0.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtccgccgacggccccaggcaagggctgggaggtgggtgactatttatactaatttgataggagtaattaaaaagttttacgacaacgtaccgtccggtaggaacgggccgtaattaccgaaccacttcctaccaacggtaaccgtacccccttaccaaaccctagtaaccgtaccgttacgttaactccgtaaacctaaatacggtaaaccctaagttacgggtacgtaaccgtaaggtttacgggaaacggtaaccgtaacgggtacccttaaaacgtttaagttttacgtttagggttacgtaacggtaaaacgtttcgttttaacgggttttacgggtaccggtaagtacctaacttacgtaaagttgggttaggtaaggtttcggggtacggccgtaccggtaccgtaccgggtaccggggtaccgaaacggggtaacctaccggttaccggtaccgttaccgttacccgttcccgtaacccgaccgtacccctaccgaaccccggtaacgggtacccccgttacgttccccggttaccccgttcccccgtaccgggtacccctaacccccggttacccgttaacccggtaacccgtacccgtccgttaacccccggg

SEQ ID NO: 43971 - DNA, 850 bp, Homo sapiens
  misc_feature: GYAE6OF02HZ40G.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcatatggcatgcacgttcggggtccgccaggccccgagggccgaaggggactggggagtggggtcggactattttactactaatttgatagggaacgtaattaaaaaaattttcgactaagtaccgttccgtaggtaaacggggcccgtaattccaacccgtaattcccgtacccaggtaaccggtaaccccctttaaccccgaaacccctaacgtaacccggtccgtacgttaaccttacccgttaaccctaaaacgttacggaaaccctagtttacgggtacgtaaccgttaagggttacggaaaacggtaccgaacgggaccttaaaccgttttaatttagttttaggtacggaacggtaaaaggttacttttagggtttcgggttaacggtacgactacgttactaaggttacggttagggtaacggttaggggttcgggtacttaccggtaaacccgtaccgggttcggggggaccctaacggggaactaccgggttcgggtaccctaccgttcccgtccgttacgacccgtaccccgtaccctaacccgggaaccgggtcccttaacccgggtttaccgttcccccgtttacccccgtccggtacccctaccccgtcccgtaaccggtaaccggacccgtacgttaaccccggg

SEQ ID NO: 43972 - DNA, 804 bp, Homo sapiens
  misc_feature: GYAE6OF02H8GOK.31.14.B03.1.454.CMB.1.raw
  modified_base (188)..(188): a, c, t, g, unknown or other
  misc_feature (188)..(188): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcacgtgggtccgccaggccccaggccaagggctgggagtgggtgctatttanactatttgatggagaataaaaattttcgcagactcgtgagggccgatcaccatcctcagacgtaccctaccaaccatacgctgtactctacaaatgaacatggtacgactagttagaagacagctaacttatagttgtgacgtaaagtgttacggtttaggtacgagtactaatacgtaacgtggtacggtaagttagggggtacggtaccgttaccgggaaccgtacccgggttcggggggaacccgtaaacggggggtaaccctaaccggggttaccggggttacccgttaaacccccgggttttcccgttaaccccgttacccggttaacccggggttaccccccttaccccggttaaacccccggggtaaacccgggggttaccccccgtaaacccgggttttcccccggggtttaacccccccgtttttacccccccccgggttacccggggtaaccccccgtttaacccccccggtttaccccccggttaaaccccggtaaacccggggttaaccccggtaccccgtttaaaccccccggggg

SEQ ID NO: 43973 - DNA, 736 bp, Homo sapiens
  misc_feature: GYAE6OF02JSZG0.31.14.B03.1.454.CMB.1.raw
  modified_base (715)..(715): a, c, t, g, unknown or other
  misc_feature (715)..(715): n is a, c, g, or t
tcagcagtagacgtcacgaccggtgctcgatttagtgtgagtagtttgggctgagctgggtttttcctcgttgctcttttaagaggtgtccagtgtcaggtgcacctggtggaatcgtgggggaggcgtggtccggccgtggggggtccctgagactctcctgtgccatgtctgcgtctgaattcatcctcgaggctactagtggacagtgcacgtcgggtcccgccacggccccaggacgaagggacgtggagtgggtgctatttagactaattgagtaggaagtaaatttaaaaagtttcgacgacgtactccggtaggacgggtacctacttaccaccatccgtaccgaagaccgtaccccttaccgaacctataccgtactagtaacctccttaaccaaagtacgaaacgttactacgggttacaacgtaaggtacggaaacgtaacgaccgttaaataacttttaagtacgtttaggaggtaaaccgttaaaggtacttttacggggtttcggttaacgacgttactacgttagaacggttagtacgggtagttagggtcgacgttaccgacgtaaccggtcgggaccgaaggtacgtacgtacggtcctaccggtcaccgtccgaccgtaccctaccggaacgacccggtcccgttaccgttccgggttacccctccccgggtacctaccccggtacccttcccggaanacccgttacgtcccgtaccgg

SEQ ID NO: 43974 - DNA, 922 bp, Homo sapiens
  misc_feature: GYAE6OF02IS63G.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctggagactctcctgtgccatgtctgcgtctgaattcatcctnaggcactatcggcatcgacctacgtcggggtccgcccacgggccccagggccgaaggggaccttgggaggtcggggtcggcctattttacactaagttttggagttagggaagtaaacttaaaaaagttttaccggactaacggaccgttaccggtaggtaacggggcctattaccaccgacttcgtaccaggtaacgtaccccgttaccaaaccacgttaaccgaccttacgtaacgttcctaaccgaaaaccgttacgaacgtaacgttacggggtacgtaaccgtaagggttacgaaacggaacgtaaccgggtacctttaaaacgttttaagttacgttttaggtacgtaacgggtaaaacggtttacggttttaaccgggttttcggggtttacggtaaacggtactaccgttaaacgttaacggtacggggttaggttaacgggttacgggggtacggtcccgttaccgggtaacgtaccccggggttacggggggaacccgtaaacggggtaacctaaccgggttaccgggtacccgtacccgggttttaccctcccgttaacccggtaccggttaccccttaaccccggtaacccgggtaacccgggtccccttaacgggtttaccccgggtttacccctttaccccgggttacccgtacccccggtttaccccggttaccccgaacggttaacccggtaccggttacccccgttaacccgggg

SEQ ID NO: 43975 - DNA, 644 bp, Homo sapiens
  misc_feature: GYAE6OF02FSWER.31.14.B03.1.454.CMB.1.raw
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacggccccaggcaagggctggaggtgggngctatttanactaatttgatgganaattaaaaatttcgacagactcgtagacggccgtattcacctatcctaccgagacgtaccccttaccaaccatacgatagtatcctacaaatgaacngtggnactagtagacganacgactaacttattatgtagacgtaaagtgtttcggttgttacgagtctattacaagttggtaggtagtaggggttcgcgttacgaccgtacggcgggaccgaagggactacgtcggtaccgaccgttccgtacctccgtaccgtccctacccgaacccgtaccgggtccctaacggttccccggttaccccgtttccccgaccggtacccctccccgttaaccccgtcccggaacgtacccggtcccgtaaccccggg

SEQ ID NO: 43976 - DNA, 645 bp, Homo sapiens
  misc_feature: GYAE6OF02IWAWL.31.14.B03.1.454.CMB.1.raw
  modified_base (528)..(528): a, c, t, g, unknown or other
  misc_feature (528)..(528): n is a, c, g, or t
tcagcagtagacgtcacgaccggtgctcgatttagtgtgagtagtttgggctgagctgggttttcctcgttgctcttttaagaggtgtccagtgtcaggtgcacctgatggaatctgggggaggcgtggtccggcctgggggggtccctgagactctcctgtgccatgtctgcgtctgaattcatcctcaggcactatggcatgcacgtgggtcccgccacggcccccaggcaaggggactgggagtgggtggctatttatacaatttgatggagaattaaaaaattttcgcagactccgtgaacgggccattcaccatctccagacgtacccttccaaccatacgctgtatctaccaaatgaacagtggtagactagttacgaaagacaacggactaaacttatttattgtagacgaaagtatttcggttaggttcgagtctaatcaagttgtaggtagtagggtggtctacgacgtaccgtaggggaccgaagggaacacgtcggtaccgaccgttctacccgttnacccgtccctacccgaaccggtaaaccgggccccctaaggtttccccggttcccgtttccccccgttaggacccctacccccttccccgttaacccgtaacggtaccgtaacccccg

SEQ ID NO: 43977 - DNA, 853 bp, Homo sapiens
  misc_feature: GYAE6OF02FX2AG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtcccgccacgggcccccgaggaccgaaacgggtactagggaggttgggggtggtacctaattttaacgtaactaagttttggagtaggtaagtaaaacttaaaaaaaacgtttttaacgacctaagtaaccgttaccggtaaggaacgggtcccgtaagtttacctaaccctatcctaccgacggaaccgtaccccctttaccaaaccctaacttaccgacttacgtacttacctaacctaaaactcgtaaactacgtaggtacgtaaccgtaaggttacgaaacggacgtaaccgggtaacttaaaccgtttattttagtttaggtaacggtaacgtaaaaggttaccgtttacgggtttacgggttacgtagtaccgtaacttaacgtagttgggttaaggtaaggttaggggtcgggttaccgtccggtaaccgtacccgggtaccggggaaccggaacgggtaaccgtaccgggttacggtaccccttccggttacccttcccgaccgtaccgtcccctaccgtacccggaacccgggtacccctaccggtttaccccggttcccccgttacccccgtcccggtacccctacccccgtttcccgacccggtaaccgtaccacccgttaaccccggg

SEQ ID NO: 43978 - DNA, 795 bp, Homo sapiens
  misc_feature: GYAE6OF02IKGND.31.14.B03.1.454.CMB.1.raw
  modified_base (110)..(110): a, c, t, g, unknown or other
  misc_feature (110)..(110): n is a, c, g, or t
  modified_base (713)..(713): a, c, t, g, unknown or other
  misc_feature (713)..(713): n is a, c, g, or t
tcagcagtagacgtcacgaccggtgctcgatttagtgtgagtagtttgggctgagcgtgggttttcctcgttgctcttttaagaggtgtccagtgtcaggtgcacctggnggaatcgtgggggaggcgtggtccggccgtggggggtccctgagctctcctgtgccatgtctgcgtctagtaacttcactccctcgaggcctaactagtggctatcgctacgtcgggtcccgaccgacgccccgaggacgaagggctggggacggtgggtcgcttaagtttactaaacttagtttaggagtagggaaagttaaaaagtttaaaaaaacgttttccggactaacggtaccttaccgggtagggtaaacggggcctaactttacccgaacccacgttacccgtaccgaacggtacccgtaaaccccctttacccgaaaacctaacgtaccggttactttacgtaaccttacctaaaaccaaaaggttacgtaaaccgtaggttacgggtaatacggttaagtaacggaacggtaccgaaccggtaaactttaacgtttactttaggttagtacgtaacgtaaggttgttttcgggtttaaggtacgataactatactaacgttgggtaaggaggttcggaggtactaccgggtaacgtccgggtacgggaaccgtacggaaaccgttgtaccggtctaaccgttctccgtaaccnccgttaccacccggaacgtacccggcttaccgtcccgtaccttcccgacgtcccaccccgtacacgtactaggaccctacgg

SEQ ID NO: 43979 - DNA, 827 bp, Homo sapiens
  misc_feature: GYAE6OF02ILBT1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtcccgccgacggccccagggccgaaaggggctagggaggtggggtgctatttataactaatttgatgggaagtaattaaaaaatttacgacaagtactaccggtggaacgggccgtattaccaacctactcctaccgaacgaccgtacccccttaccaaacctactaccgcttagtaactacctaacctaaaagtcgaaactacgtagggtacgtaactaaggttagaaacggtaccgaaacggtaccttaaacgtttaactttagtttacggtacgtaaccggtaaaagttacgtttttaccgggtagggtttaccgaagtactaattaccgtaaagttagggttagggttaacggtttagggggttaccgtaccgttaccggtaacccggtaccgggttacgggggacccgggtaaacgggtaaccctaccggttacgggtaccccgtacccggttcccgttacctacccggtaaccgtcccctacccgtaacccgggaacccgggtccccgtaacccgtttcccgggttaccccccgttttcccccggaccggcccccgttaaccccgttaccccgacccgtaacgtccccggtacccgttaaccccggg

SEQ ID NO: 43980 - DNA, 843 bp, Homo sapiens
  misc_feature: GYAE6OF02J1M85.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctagaattcatcctcgagcactatggcatgcacggtgggtcccaccgacggccccgaggacgaagggactaggagtggggngactatttacactagttgagtaggaagtaaattaaaaacgtttacgacgaacgtacgtcggtaggtaacgggacctataccaccgactacctaccgaacggtacccgtaccccttacccgaacctactacgtccttacgtacttacctaacaaaagtacgtaactagtaggtacgtaacgtaggttaacgaacgtaaccgtaacggaacctttaacgtttaacgtttacgtttaggtaaccggtaagttaaaacggttaccggttttacggtttaccggggttaccgtaacgtaccgtaaacttaaccgttaaggttgggtaagggttaaacgggttggggttacggtacccggtaacccgggtacccggtacccgggtacggggggtaaccccggtaaacgggtaacccggtaccgggttaccgggtaacccgttaccccgttacccgttcccgaaccggttacccgacccccgtacccgaaacccgggtacccgggtaaccctccgggttacccggttcccccgttccccgtaccggtacccccttacccgtacccgacccgtaacggtaccctaccgtcccggg

SEQ ID NO: 43981 - DNA, 791 bp, Homo sapiens
  misc_feature: GYAE6OF02G3TET.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtcgggtcccgccacggccccaggacgaagggctgggagtgggtgctatttagactaatttgagtaggaagtaattaaaaaatttacgacagtactccgtaggaacgggtccgtacgttacacctatccgtaccgacgtaccgtaaccccttaccgaacctataccgtctacgtaacttccgtaacctaaaagtacgaaacctagttagggtacgaacgttaaggttaggaaacgtaacgaaccggtacctaaacgtttagtttaagtttgtaggaacgttaaagtacgttttacggtttacgggttacgtaacgtacgtaacttacgtaacgttggttaacgggtaaggttaacggggttcggtaccgtacgaacccgaccgggttccggggaaccgaacggggtaacctacgttacgggtacccgtaacccgtttcccgtccctaaccgaccgtaccccgttacccgaaacccggtacccgggtacccctaacggtttccccggttccccgttacccccggtccggtacccccttaccccgttaccccgtaacccggtaccgtacccgtaccctaacccgggg

SEQ ID NO: 43982 - DNA, 703 bp, Homo sapiens
  misc_feature: GYAE6OF02FM89X.31.14.B03.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcatgggtccnccaggccccaggcaagggctggagtgggtgcattanacatttgatgganaattaaaaatttcgcagactccgtagaagggccattcaccatctccagacacccttcaaccatacnctgtatcctacctaaatcgaacagtggtagactagttacgaagacacggactaactttattattgtagacgtaaagtgtttcgttaggttacgagtacaatacgtaagtggtaggaagttaggggtcggtacctcggtaccctacccgggtgggggtacccgaaacgggggtaaccctaaccggttcgggttacccgtaacccgggtttcccttacccggtaccgtaaccggtccccttaccccgaacccggtaaaccggggggtccccctaacggtttccccggggttacccccgttttacccccccggtaccgggtacccgttaacccccctttccccggtaacccctaaacgggaccgtacccctaccccggg

SEQ ID NO: 43983 - DNA, 820 bp, Homo sapiens
  misc_feature: GYAE6OF02HE0XM.31.14.B03.1.454.CMB.1.raw
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcactcctcaggcactatcggcatcgctacgtcgggtcccnccgacggccccaggaccgaagggactgggaggtcgggtgactaagtttacactaagtttgataggaagtaaattaaaaaagttttacgactacggtaccgtccgttagggaacggtacccgtattacccgaacctacgttacccgtaccgaaacggtaccgtaaccccccgtttaacccaaacccgtaacgttaaccggtaccgttacggttaacttaccgtacccaaagttacgaaaccgtagttagggtactaacgtagtttacggaacgtaaccgacggtaactaacgtttaatttacgttcggtaacgtaacgtaaacgttacgtttcggtttaggtaccgaagtcgtaagtcgtaaagttggtagggttacggttacgggtcggttacctaccggtaccgtaccggttcggggaaccggtaagggtaacctaccgtacggtaccgttaacccgttccgtacccgtacgtaccgttacccacccgtaacccggaccgggtacccctacggtttacccggtccccctttccccggtacgtccccgttaaccccgttaccgttccccgaaacggtccccgtaccgttaaccccggg

SEQ ID NO: 43984 - DNA, 840 bp, Homo sapiens
  misc_feature: GYAE6OF02G4XPP.31.14.B03.1.454.CMB.1.raw
  modified_base (262)..(262): a, c, t, g, unknown or other
  misc_feature (262)..(262): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcgaggacactatcggcagtgccacgtcgggtcccgccgaccggccccgaggacgaagggactgggaggtgggtgnttattatactagttgagtggaagtaaattaaaaatttacgactaagtaccgtccggtaggaacggaccgtatccgacctatcctccgaacggtaccgtaccctacccaacctataccgtcgttacgtacttacctaaccgtaaanaccgtaaacgtagttagggtacgtaaacgtaggttaacggaaacggaccgtaaaccggtaccttaaacgtttaatttacgtttacggtaggtaacggtaaaacggtttcgttttacgggtttacgggtttaccggaacgttactagtaccgttaaaaggttcgggtaagggttaaggttacggggttcgtacccgtacgggtaaccgtaccgggttacggggacccgtaaaggggtaccctaacggttaccgggttaccctacccgttaccgtccccttaccggtacccgttccccgttaccccggaacccgggtaacccggggtacccccttaaccgggtttcccccggttaccccgttcccccccggttaacggccccccttacccccggtacccttaccccgaaccggtacccgtcccgtaaccccgggg

SEQ ID NO: 43985 - DNA, 681 bp, Homo sapiens
  misc_feature: GYAE6OF02JPWG7.31.14.B03.1.454.CMB.1.raw
  modified_base (646)..(646): a, c, t, g, unknown or other
  misc_feature (646)..(646): n is a, c, g, or t
  modified_base (652)..(652): a, c, t, g, unknown or other
  misc_feature (652)..(652): n is a, c, g, or t
tcagcagtagacgtcacgaccggtgctcgatttagtgtgagtagtttgggtcgtgagctgggttttcctcgttgctctttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaggtccccagggctaaagggacctgggacgtggggtcggctattttaactactaaatttgatagggtacgaaattaaaaaacgttttcgaccgtaagaccttccggtaggaacgggcccgtattccaacctaatcctaccaagtaccgtaccccttaccaaaccatacgctacgttactcctaccaaatacgaacagtggttacgactaagttcgaagacacggactaacttattattagtgaacgaagtacttcggtttaggtacgagtctatacaaacgttggtaggaagttaggggtgtaccgtacgaaccgtaccgggttacgggggaccgaacggggaacctaaggttcgggtaccgtacccgttctacccgttcgacgttccgacccgtaccgacgggtcccacggttcgtccccttcccgngtcccncccgttaccaccgtagacctcgtaacccg

SEQ ID NO: 43986 - DNA, 815 bp, Homo sapiens
  misc_feature: GYAE6OF02GNZCW.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcaactatggcatgcacgtcgggtccgccacggccccaggcgaagggctggagtgggtgactatttagtactaatttgagtggaagtaaattaaaaaagttttcgactacgtaccgtccggtaggaacgggtaccgtattaccgaacctactcctaccgaacgtaccgtaccccttaccaaccgtactacgcttagtactacctaaccaaatcgaaacgtagttaggtacgaacgtaggttacgaaacgaccgtaaccggtacttaaacgtttaagttacgtttggtaacggtaacgtaaaacggtttacgttttacgggtttagggttaccgaagtacctaaacgttacgtaaagttcggtagggttaaggttaggggttcggtaccgttaaccggaccgtaacccgggtagggggaccgaacggggtaaccctacggttcggtacccgtacccgttccgttacccgtacgtacccgaccccgttacccgaaaccggtacccgggtaccccgttaaccggtttccccggggttcccctttacccccccggtagggtacccccccttaccccggtttaaccccgtaacccgtaaacgggtaccccgtaccccgttaaccccggggg

SEQ ID NO: 43987 - DNA, 719 bp, Homo sapiens
  misc_feature: GYAE6OF02JSSGX.31.14.B03.1.454.CMB.1.raw
  modified_base (227)..(227): a, c, t, g, unknown or other
  misc_feature (227)..(227): n is a, c, g, or t
tcagcagtagacgtcacgaccggtgctcgatttagtgtgagtagtttgggctgagctgggtttcctcgttgctctttaagaggtgtccagtgtcaggtgcacctggtggaatcgtgggggagcgtggtccggcctgggggtccctgagactctcctgtcgccatgtctgcgtctgaattcatccgtcaggccaactagtggaccagtgacctacgtcggggtacccnccgccggaccccagggaccgaaaggggtcgtgggaacggttggggtcgtacttaagttttacaactaagtttggaatacgggtaataaaacctttaaaaaagttttccgacgtagtacctaccggtaggaacgggccttaatccacacttccggaccaacgccgaccccttaccaactacgtacctcttagtacctcgtaacaaagtcaactgtagtcaacgtagtagacaacgtgaaccttagttaatcgttagaccgtagaaagtcgttacgttcgtagactagtactaacgtagtgtaggtacgtagggtacgaccgtaggtaacccgtaggccgggtaacgaccggacggtactcggtacccgtaacccgttcgacctacccgaccaccccgttacgacccggtaacggtcccccttagtcccgtttaaccccgtccccgccgtaccctccccggtacctaacccggtaagacccttaccggtcccgg

SEQ ID NO: 43988 - DNA, 742 bp, Homo sapiens
  misc_feature: GYAE6OF02G91K4.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactagtggcatgcacgtcgggtcccgccacggccccaggcgaagggactgggagtgggtgctattatactattgatggagtaattaaaaatttcgacaagtcctccggtaggaacgggtccgattaccaaccacttcctaccgaagaccgtaccccttacccgaaaccgtaacgtaccgtacttacggttaacttacccgtaaccctaaaatacgaaaccgtaggtttacgggtacgaaagttacggttaggaaaacggtaaccgaacgggtaaccttaaacttttactttaagttcggttaacggaacgtaaaaggtacgttttcccggtttaggttacgacgtactactactaaagttggtagggtagttaggggtcgaccgtaccgacgtaccgggtcggggaccgaacgggaacctacgtacggtaccctaccggtcctccctacgccgttacccaccgaacccggaccggtcccgtacgttcccggtccctttcccccgtgaccccttacccgtacccgacccgtaacgcgtacccgtacccgg

SEQ ID NO: 43989 - DNA, 757 bp, Homo sapiens
  misc_feature: GYAE6OF02F13CA.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttggcgtgagctgggttttcctcgttgctctttaagaggtgtccagtgtcaggtgcacctggtggaatctgggggagcgtggtccggccgtcgggggtccctgagactctcctgtgccatgtctgcgtcctgaattcatcctcaggcactatcggcatgcacgtcggtccgccacggcccaggccgaagggacgtggagtgggtggactatttanactagtttcgagtagagtaataaaaaattacgcacgacgtcgtagaacggtcgacttacgaccagtctaccgagtaacgtacctaccgaaccagtacgcgtagttactacctacgtaactacgaactagtgggtacgacgtagttaagaacgtaccgaacgtaccttaaacgtttattaacggtttgtacggtaacgtaaaggtacgtttcggtttacggttacgtaggtctaacgttacgtaattacggttacggaacggttacgggtacgtaccgttaacggtaaccgttcccgggtaaggggttacccggaaacggggttaacctaacccggttacgggttaaccccaacccggtttccgttacccgtaacgtacccggttaccctcggaacccgtaacggggtccccctacggtttacccgggttaccctttccccccggttaggaccccttacccccttaccggtaacccgacggtaacgtcccgtacccgg

SEQ ID NO: 43990 - DNA, 781 bp, Homo sapiens
  misc_feature: GYAE6OF02IKBAN.31.14.B03.1.454.CMB.1.raw
  modified_base (299)..(299): a, c, t, g, unknown or other
  misc_feature (299)..(299): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgtctgaattcatcctcaggcactatggcatgcactcgggtccgccgacggccccgaggcgaagggactgggagtggggtgctatttatactaatttgatggtaagaaattaaaaaagttttacganacgactccggtagaacggggccgtattccaacctactctacccagaaccgtaccccttacccaaccactacgcttagtactactaccaaagttagaactagtaggtagaacgtacgttagaaaacggtacctaacgggtaacctaaactttaatttaatttcggtacgtacggtaaaagtacttttacgggtttgggtttaccgagtacgtactacgtaaagttcgggttagggtaaggttaaggggttcgggtaccgtccggtaaccgtacccgggttacgggggacccgaacgggggaaacctacgtaccgggttaccctaacccgggttccttacccgtccgtaccgacccgttaccccaacccggtaccggggtaaccctaccgttccccgggttcccctttaaccccccggttccggtaccccctacccccctttacccgttaccccggaaagtaccccggacccttaacccccggg

SEQ ID NO: 43991 - DNA, 792 bp, Homo sapiens
  misc_feature: GYAE6OF02HHDLU.31.14.B03.1.454.CMB.1.raw
  modified_base (252)..(252): a, c, t, g, unknown or other
  misc_feature (252)..(252): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttanacatttgatggaagtaataaaaatttacgactagactccgtgaacgggccgaattcaccatctaccagacgaccccttaccaaccataccgctgtactcctaccaaatacgaaacagtggtacgacgtagttacgaaacggaaccgaaccgggtaccttaaacgtttaagtttaacgtttaggtacggtaaccgtaaaaggttacgttttacgggtttagggttaccgaaggtacctaagttaacctaaaggtttaggttaagggtaaggttaagggggttacggtacccgtaccggtaaccgtacccgggttacgggggacccggtaaacggggaaaccgttaccggtacgggttacccgtaacccggttcccttacccggttaccacccggtaccccttaccccgaaccccgggtaaccggggtacccccttaaccggttccccgggttacccccgtttaccccccggttaccggtacccccgtaccccccgttaccccgtaaccccgtaaacggtaacccgtccccgtaaccccggg

SEQ ID NO: 43992 - DNA, 661 bp, Homo sapiens
  misc_feature: GYAE6OF02GQMU5.31.14.B03.1.454.CMB.1.raw
  modified_base (219)..(219): a, c, t, g, unknown or other
  misc_feature (219)..(219): n is a, c, g, or t
  modified_base (390)..(390): a, c, t, g, unknown or other
  misc_feature (390)..(390): n is a, c, g, or t
  modified_base (653)..(653): a, c, t, g, unknown or other
  misc_feature (653)..(653): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcattcctcaggcactatggcagtcgcacgtcgggtcccnccgacggccccagggcgaacgggctgggacgtgggtgctatttatactaagtttgagtggaataattaaaaacgttttcgacacgtacctcgtaggacgggcctattcacatcacgagactaccccttccaaactctacgcttagtactcctacaatcgaactagtggtanacgtagtacgaacacgacgtacttaacgttattagtggtacgaacgtaaaggttcgttttacggtttagggtacgtaagacgtaacgtactaaaggttcggtagggtaaggttacggggtacgtcccgtacggtacccggaccgggttacgggggaccacgggtaacctacgggtcggtacccgtaccgtcctccgtacaccgcctaccgaccggtacgcctacgtccgtccctcccgacgccctaccctcctacgacgtacncctaccgg

SEQ ID NO: 43993 - DNA, 742 bp, Homo sapiens
  misc_feature: GYAE6OF02JLQ1K.31.14.B03.1.454.CMB.1.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgttggtccgcctgggggtccctgagactctcctgtgccatgtctgcgtctgaattcgatcctacgaggcactagtcggcatgcctacgtgggtcccgccagggcccccagggacaacgggactgggtagtcggggngtttttcaacgttttanaacctaagtttgaagttcgggaagtaaactttaaaaaaattttccgacgtaacgtaccgttacccggtaggaacggggtacccctaagtttaccaaccgtattcccgtaccgaaggtacctaaccccttaccaaacctacgttacgccttagtactccgtaacctaaagtacactagtgggtacacgtaagtcgaaacggtacncggtaactaacgttagttanggtacgagtaaacgtgtttcggttggtacacggtctaacgtcgtaagtcggtagtacggttaggcgggtactcggtaacgaccgtgggaccgtaaggactacgtacggtacccgtacgtcctacctacgacgaccccttacggaacccggaaccggtcccgtagtaccccgggttaccccttccccggccggtaacctacccccgttccccgtaagaacccgttacgcccccgttaaacgg

SEQ ID NO: 43994 - DNA, 622 bp, Homo sapiens
  misc_feature: GYAE6OF02I3F3B.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccacggccccaggcaagggactgggagtgggtgctatttanacatttgatggagaataaaaattttacgacagactccgtgaagggccgtattcaccatctaccagacgaccccttaccaaccataccgctgtatcctacaaatgaaacagtaggtgaactagttagaagacgacggtacaacttacttagttgtaggacgtaaagtatttcggttaggttacgagtactatactaagtggtaggtagtagggtggaccgtaccgacgaccggttggggacccgagggaacctacgtcggtacctaccgtcctcctacgaccgtccctaccgaccgaaccgggccctacgttcccggttcccttccccgtcgaccctaccctcccgtaccaacgtccgacctacccgg

SEQ ID NO: 43995 - DNA, 750 bp, Homo sapiens
  misc_feature: GYAE6OF02FW7F9.31.14.B03.1.454.CMB.1.raw
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (738)..(738): a, c, t, g, unknown or other
  misc_feature (738)..(738): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgctacgtcgggtcccnccgacggccccaggccgaagggactgggnggtgggtgctaatttataactatttgatggaagtaaattaaaaaattttacgacgaagtacctaccggtaggaacggggtccctaatttaccaaccgtactccctaccgaacggacgtaaccccccttaccaaacccacgttacgtcttagttaactacctaaccaaagtcgaaacgtgtaggtacgaacgtaaggttacgaaacggtaaccaacggtaccctaaacgtttaatttacgttacggtacggaacggtaaagttacgttttacggtttcgggtttacgagtactagtactaaggtggtaggtaggtacgggtgccgttaccggaccgtacgggtcggggaccgaacggggtaacctacggttcggtacccgttacccgtccttaccctcgaaccgtccctaccgaaccggtaccggccctaacggttcccgttccccgttaccccggcgtacccctaccccgttacccaccgaacggtacccncccgttaaccgg

SEQ ID NO: 43996 - DNA, 677 bp, Homo sapiens
  misc_feature: GYAE6OF02JY90C.31.14.B03.1.454.CMB.1.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctggggggtccctgagactctcctgtgccatgtctgcgtctgaattcatcctcaggcactatggcatggcactgggtccnccaggccccaggccaagggctgggagtgggtggcatttanactaatttgatggaagaattaaaaatttcgctagactccgtgaggcatcacatcncagcgacccttcaaccntacgctgtactctacaaatgaactatggtacgaacttaggttagaacgtacacgggtactaacgtttattacgtgtacgacgtaaagtatttcggttaggttcgacgtcaacgttacgtaagtggtaggtacgttaaggggtgtaccgttacgaccgtacccggttacggggaccgtaagggaaccgtaacggtcggttaccgaacccggttccgttccgacccgtacggtccctacccgaaccggtaacccgggcccgttaccgttaccgggtttacccctccccggttaccgggtccccttaacccccgcccgtttaccccggaacgtacccgggtaccctaaccccggg

SEQ ID NO: 43997 - DNA, 920 bp, Homo sapiens
  misc_feature: GYAE6OF02GMCH5.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctggagactctcctgtgccatgtctgcgtctgaattcatcctcaggcactatggcagtcgactcggtcgggtccgccgaccggccccgaggacgaagggtacgtgggtaggtgggtcgtacttagtttaactaacgttaagtttagaggtagggaaagttaaaaacttttaaaaacgttttccgacgtaacggtaccccgttccgggtaagggaaccgggtaccgttaacgttacccgaaccgttaaccttcccgtaccggaacgtaacccgttaacccccttaacccgaaacctacgtaacccgtccgttacgttaaccgtaccccttaaaccgtaaacgtaacgaaacgtaggttcggtaaccgaacggttacggttaacggaaacgtaaccgggtaaccggttaaaccttaaaccgttttaagtttacgtttacgggaacgtaaaccggtaaaggtttcggttttaccgggtttacggtaaccgacgtaccgtaacgtaagtacggttagggtacggtaacgggttggggtaccttccgtaccggtaacccggtaccgggtaccggggaaccaacgggggtaacccttacgggttaccggtacccgtaacccgtttccgtaacccgtaaccgtcccgtaccccgttacccggaaaccggtacccgggacccttaaccgggtttcccccgggtttaacccctcccccgggtacgtaccccccttaccccggttacccgaaacggtaccggacccgtaccccggttacccggg

SEQ ID NO: 43998 - DNA, 774 bp, Homo sapiens
  misc_feature: GYAE6OF02H2SB4.31.14.B03.1.454.CMB.1.raw
  modified_base (175)..(175): a, c, t, g, unknown or other
  misc_feature (175)..(175): n is a, c, g, or t
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagttgggtctgagctgggtttcctcgttgctctttaagaggtgtccagtgtcaggtgcacctggtggaatcgtgggggaggcggtggtccggccgtgggggtcctggagactctcctgtgccatgtctgcgtntgaattcatcctcaggcacttanggcatcgactacgtgggcccgaccgaggccccgaggcgaaacgggtctggggaggtgggtggactatttacaacgtaatttgaagtggagaataaaaattttacganagacttcgngtaacggggcacttcgacatcctaccagtacgacccttaccaaccatacgcttagtactacttaccaaattagaacctagtaggtacctagtaacgtttacggaaaacgtacgaaccgggtaacctaaattttaaccgaaagtttttcggaagtacggaaagtacgtttaaccggtttggttagtacggtaactagttanaagttaggaggtaaagttgggttaacggcgtttacgacgtaacccgggtggggtacccggaaaggggtaccgtaacggttccggtaacccgtaaccggttacccgttcccggaccgtaaccggtacccccgtcccgttaaacccgggtaacccggacccccgtaacggtttacccgggtaccccggtttccccccgttaagggccccttaaccccctccccggtaaacccgttacgtacccgggaacccttaaccccggg

SEQ ID NO: 43999 - DNA, 602 bp, Homo sapiens
  misc_feature: GYAE6OF02I7C8W.31.14.B03.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctaaattcatcctcaggcactatggcatgcacgtgggtccnccaggccccaggcaagggactggagtggtgcatttanacatttgatgganataaaaattttacgcanactccgtgaaggccattcacatctccagagacccttcaacctatacgctgtactctaccaaatgaactagtggtagaccagtttgaagacacggactaaacgttattaattggtagacgtaaagtagtttcgttgggttcgaggaccagttacaagtgtaggtaagttagggtcgacgtcgactccgtaggggaccgagggaacacgtgtaccgaccgtcctcccgacgccctaccacccgacggcccctaggtcccgtccttcccccgtacgccctacccgtccccgtaccgacgaccgccgtacccgtcgtaccgggg

SEQ ID NO: 44000 - DNA, 737 bp, Homo sapiens
  misc_feature: GYAE6OF02GXPMB.31.14.B03.1.454.CMB.1.raw
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctnaggcactatggcatgcacgttcgggtcccnccgacggccccagggcgaaagggctgggaggtggggtgctaatttataactaatttgagtaggaagtaaattaaaaaattttcgacaagtactaccggtaggaacgggtccgtaacttaccaacctactcctaccgaaggtaacctaccccttaccaaacctatacgtccttagtactcctaaccaaatacgaactagtaggtacgacgtaagtagaacgtacgacggtacttaaatttagttacgttaggtacgacggtaaagtttcgttcggtttagggttacgagtacctagtacgtaagtggttagggtaacggttacggggacgtaccgtcgaaccgtaccgggtgggaaccgtaacgggtaacctacgggtcgtacccgtacccgttacctaccgtaccaccgtcccgtacccgaccggtaaccgggcccttaaccggttcccggttaccccttcccccggtacgtccccctacccgttccaacccgaacggtcccgtacccgtaccccggg

SEQ ID NO: 44001 - DNA, 614 bp, Homo sapiens
  misc_feature: GYAE6OF02IS8ZL.31.14.B03.1.454.CMB.1.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacggccccgaggaccgaagggactgggaggtggggtggacattttaatactaatttggatgggagtaataaaaaagtttttacgacagactcccggtaggaagggccgtattccgaccatcctccagacgacccttccaaccataccgctgtactctaccaatnaacatggtanactagttagaacgacgacggactaacttattacgttgtgacgtaagtagttcgttggtcgagtacatacatggtagtagtagggtgcctcgacnccggagggccgaaggacacgtgtaccnccgtctcgtcacgtccaccgaccgaacgggccctacgtcccgtcccgttaccccgtcggtaccctaccccgttacccgaccaacggtccgaccctacccgg

SEQ ID NO: 44002 - DNA, 879 bp, Homo sapiens
  misc_feature: GYAE6OF02ICUY1.31.14.B03.1.454.CMB.1.raw
  modified_base (223)..(223): a, c, t, g, unknown or other
  misc_feature (223)..(223): n is a, c, g, or t
tcagcagtagacgtcacgaccggtgctcgatttagtgtgagtagtttgggctgagctgggttttcctcgttgctctttaagaggtgtccagtgtcaggtgcactggtggaatcgtgggggaggcgtggtccggccgtgggggtccctgagactctcctgtcgccatgtctgcgtctgaattcactcctcaggccactagtggcactcgcaccgtcgggtaccnccgacggcccccgagggcgaaacggggtaccgtgggacggttggggtaggacttaagtttaactaacgtaagttttgagttagggaaacgttaaaagtttaaaaaaacttttcgaacgtactaaccggtacccggtaagggaaccggggtaccgtaacttacccaacccgtaacttaccctaccggtaacgaaccggtaacccccttacccgaaacctaacttaaccggtcttacgtaacttacccttaaaccgtaaactacggtaaactaggtttacggtaccgtaaaccttagggttaaccggaaacgtaccgaaccggtaaacttaaaccgtttaagtttaagtttcgtacgtaacggtaaaggtttacgtttaccgggtttcgggtaagtagtacctaacgttacggaagtttacgggtagggttaacggttacggggtcggttaccgtccggaaccggtaaccgggttcgggggaaacccgtaagggaaccctacgggttaccggacccgttacccggttcctaccgtaaccaccgtaccccgacccgaaaccgtacccggggtaccctaacgggttccccgttacccgttcccccgtaccggtacccctaacccccttccgaaacccggacgtaccctcccgtacccggg

SEQ ID NO: 44003 - DNA, 1023 bp, Homo sapiens
  misc_feature: GYAE6OF02HWRV2.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatcgcacgtcgggtccgccgacggacccccagggaccgaaagggtaccgtggggacggttgggggtggaccttaagttttaactaaccgttaaattttggaagttagggaaagttaaaagtttaaaaaaaaacgtttttaccggaacgtaaacggttaacccgtacccgggtttaagggaaaaccggggtcccggttaaactttcccaaacccgtaacgttccctacccgaaacggtaaccgtaacccccttttaacccaaacctaacgttaacccggtcgttacggttaactacccttaaccgtaaaagttaacggtaaaccgtaacgttacgggtaacgtaaaccggttaacgggtttaaaggaaaccggtaaacccgtaaccggggtaaacccttaaaaccgtttttaagttttaaacggtttaccgggttagggtaaaccggtaaaaacggtttacggtttttacgggttttaacggggtttaccgtaaagggtaccttaaaacgtaccggtttaaagtaggggttaacgggtaagggttttacggggggacggttacccggttaaccggtaaccccggtaaccggggttacggggaacccggtaaacgggggaaccgtaccgggtttacgggtaccccggttaccccgtttcgtaccccgtaccgtacccggtcccgttaacccccgaaccggaacccggggtaacccccttaacgggttttccccgggtaccccctttccccccgggtaccggtaccccccgtaccccgtttaacccccgaaccggaaaccccgttacggtcccccgttaaccccgggg

SEQ ID NO: 44004 - DNA, 714 bp, Homo sapiens
  misc_feature: GYAE6OF02J0UX2.31.14.B03.1.454.CMB.1.raw
  modified_base (270)..(270): a, c, t, g, unknown or other
  misc_feature (270)..(270): n is a, c, g, or t
  modified_base (674)..(674): a, c, t, g, unknown or other
  misc_feature (674)..(674): n is a, c, g, or t
tcagcagtagacgtcacgaccggtgctcgatttagtgtgagtagtttgggctgagctgggtttcctcgttgctctttaagaggtgtccagtgtcaggtgcacctggtggaatcgtgggggaggcgtggtccggcctggggggtccctgagactctcctgtgccatgtctgcgtctagaattcatcctcaggcacgtagtcggctagtcgcacggttcgggcccgccgacggccccagggacgaagggctgggacgtgggtgactatttanacgtagtttagagtaggaacgtaaattaaaaacttcgactacgtactcggtaggaacggggcctaattaccaccgtactcctacgaacgtaccggtacccttaccgaaacctacgtaacgtcttagttactacgtaaccaaagtacgtaaactacgtaggtacgtaccgtagttaacgaacgtacgaacggtacttaaacgttagttacgttcgacgtacgtaaagttcggtttacgttacgggtacgaacgtactaatacgtaagttaggtagtaggtacgggtgtaccgtacgtacgtaccggtagggaccgaacgggtacacgttcggtacctaccgtctaccacgtaccgaccgttaccgaaccggtaccgccgtacggttcccggttacccttccccgnggtacccctaccgtcccacgtaacgccgtaccgtacccgg

SEQ ID NO: 44005 - DNA, 661 bp, Homo sapiens
  misc_feature: GYAE6OF02J1Q24.31.14.B03.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggctactatggcatgcncgtgggtccnccacggccccaggcgaagggctaggagtgggngactagttanactaattcgagtggaataattaaaattcgntagtacctaccggtaggaaggcctatcacnctactcagacgtaccctacaacnctacnctagtactctacaaagtnaacgtgtaggtacacgtagtacggacaacgagtctaaacttagttagtacgtaggtaactaaggtactttggttacgggtaccagttacgacttaagtaaccgttggtaagtaggtacgggtctaagaccgttacaaccgggttacgggacgtaacggtacgtcgtaacggtcccacggttacttaccncggttaccnccgtacccggtacggaccggtcctaccggtacgttcccccgtaaccttcccgggtcccttaccgacccggttaccgaccggtacccgtaccgtcccggg

SEQ ID NO: 44006 - DNA, 762 bp, Homo sapiens
  misc_feature: GYAE6OF02F8WD5.31.14.B03.1.454.CMB.1.raw
  modified_base (213)..(213): a, c, t, g, unknown or other
  misc_feature (213)..(213): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccnccaggccccaggctaagggctgggagtgggtggactagttttatactatttgattaggagtaactttaaaaaagttttcgacgtaagtaccgtccggttaggaacggggtccgtaactttaccgaaccacgttccttaccgaaggtaccgtacccctttacccaaacctacttaccgtcgttagtacttaccgtacctaaaagttcgaaacctagtcgggtacgacgtaagttacggaaagtaaccgacggtacctaaacgtttattacttacggtgaacgtaaagtacgtttcggttaggtttcgagtcaatacgtaagtggtacgtagtacgggtggtcctaccggacgtaccggtacggggacctaagggaactaccggttcggtaccgtaacccgttccgttacccacgtaccgtccccttacccgaaccggtaacccggggttcccctaacggtttccccgggttcccctttaccccccggttagggacccccttaccccgttaccccgttaacccggaaacggtcccgacccgttaccccggg

SEQ ID NO: 44007 - DNA, 748 bp, Homo sapiens
  misc_feature: GYAE6OF02H6BQT.31.14.B03.1.454.CMB.1.raw
  modified_base (215)..(215): a, c, t, g, unknown or other
  misc_feature (215)..(215): n is a, c, g, or t
  modified_base (649)..(649): a, c, t, g, unknown or other
  misc_feature (649)..(649): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggctggggggtccctgagactctcctgtgccatgtctgcgtctgaattcatcctcaggcactatggcatgcacgtcgggtccnccaggccccaggcgaagggctgggagtgggtagactatttacgactaagtttgataggaagtaaaattaaaaaattttccgactaacggtacctacccggtaggaacggggtaccctaattacccaaccgtattccgtaccgaacggtaaccgtaacccccctttaccaaaaccctacgttaccgtaccgttagttaacctccgtaacctaaagtacgaaacgtagtcggtagtaacgtaagttaggaaacgtaccgtacgtactaacgtttattacgtttagacgtaacggtaagttcgttttcgggttaggttaccgaagtactagtacgtaagttggtagggtagttagggtcgtacctacggaccgaccgggttcggggaaccgtaacgggtacctacggttccgtaccgtacccggttcctaccgtacnccggtaccctacccgaacccggtacggcccttacgttcccggtccctttccccgacggtccctaccccgtccaaccgaacggtccgtacccgtacccgg

SEQ ID NO: 44008 - DNA, 774 bp, Homo sapiens
  misc_feature: GYAE6OF02H2GA1.31.14.B03.1.454.CMB.1.raw
  modified_base (217)..(217): a, c, t, g, unknown or other
  misc_feature (217)..(217): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagttgggctgagctgggttttcctcgttgctcttttaagaggtgtccagtgtcaggtgcacctggtggaatcgtgggggagcgtggtccggccgtgggggtccctgagactctcctgtgccatgtctgcgtctgtaattccatcctcaggcactagtgcagtgcacgtgggtccnccgaggccccaggacaagggactgggacgtgggtagctatttataacgtaattttgaacttggaagtaaattaaaaaagttttacggacagtactaccgttggaaggcccgaattccgaactatccgtaccgaagaccgtacccgttccaaacctagtaccgtcgttagtaacgtcctaacctaaacgtataaccgagtaaggtnaacgtaggttaacgaaacgtacctaacggtacctaaaacttttagttaactttcggtataccggtaaaagtactttacggttacggtacgtaacgtacgtaaagtaccgtaaagttggttaacggaacgttacgggggttcgaccgttaacgtaaaccggaccccgtagggggtaacccaaagggtaaccccgtaagttcggggtaccaacccgggttcctacgttacccgaacgtaccctacccgtaaccggaaccgggtaaccccctaggttacccgggttcccttacccccggaggttacccctaacccggttcccgtaaccccgaaaggtccgtaccgttaaccccgg

SEQ ID NO: 44009 - DNA, 676 bp, Homo sapiens
  misc_feature: GYAE6OF02HG538.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgacgactctcctgtgccatgtctgcgtctgaattcatcctcaggcactatggcatgcactgggtccnccaggccccaggccaagggactgggagtgggtgcatttanactaatttgatggagtaataaaaattttacgcagactccgtgaaggccattcaccatctccagacgaccccttccaacctatacgctgtatcctaccaaatgaacatggtgacagttgaagacacggactaacttattagttgtagacgtaaagtacgtttcggttggttacggagctaattactaagttggtaggtaagttagggggtcgcgtaccggaccgtaccggttgggggacccgaaggggtaaccacgttcgggtacctaaccccgggttccttcccgtaccgaccgtccccgtaccccgaaccggtaaccggggcccctaaccggttcccgggttcccctttacccccccggtggggtaccccctacccccgttacccgttaccccgaaacggtacccgtcccgtaaccccggg

SEQ ID NO: 44010 - DNA, 836 bp, Homo sapiens
  misc_feature: GYAE6OF02H6NBD.31.14.B03.1.454.CMB.1.raw
  modified_base (179)..(179): a, c, t, g, unknown or other
  misc_feature (179)..(179): n is a, c, g, or t
  modified_base (445)..(445): a, c, t, g, unknown or other
  misc_feature (445)..(445): n is a, c, g, or t
  modified_base (475)..(475): a, c, t, g, unknown or other
  misc_feature (475)..(475): n is a, c, g, or t
tcagcagtagacgtcacgaccggtgctcgatttagtgtgagtagtttgggctgagctgggttttcctcgttgcttcttttaagaggtgtccagtgtcaggtgcaccgtggtggaatcgtgggggaggcggtggtccggccgtgggggtccctgagactctcctgtgccatgtctgcgtntgaatctactcctcgaggcactagtggctagtcgctaccggtcgggtccccgaccgaccggaccccgaggacggaaagggtacgtggggtagggttggggtacgtacttaaattttacgtaaacgttaagtttggaaggtagggtaaaattaaaaatttaaaaaacttttccggacgtacggtaaccgttaccggtaaggggaaccgggtacctaacttaccacctacgtacctaccgaaacgtacccgtaccccttacaaaccgntacggtacttcgtaactccgaactaaagtnaaacgtggtgtacgacgtaaggtcaaacgtaccgacgttaaacctaattttacggttactgggtaacgtaaacgtaaattacggtttacggtttcgggaactagtacgtaacttaaagtagggttggtagggttaaaggtcgggttacggtaccctcggtaaaccggtaccggggttaccggggaaacccgtaaggtaaccgtacccgttacggtaccgttaccccgtctaccccgtagaaccccggtcccaaaccggtacccggtaacccggcccttaaccgttccccgtaaccccgtcccccggtttagcccccttaaaccccggttccgaaacccgggagtaccccggtcgtaccggg

SEQ ID NO: 44011 - DNA, 848 bp, Homo sapiens
  misc_feature: GYAE6OF02ISZ2Y.31.14.B03.1.454.CMB.1.raw
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgattcatcctcaggcactatggcatgcacgtcgggtcccgccgacggccccagggaccgaagggacgtggagtgggtagctatttanactaattgagtaggtaagtaaagttaaaaaatttacgactaacgtaccgtaccggtaggaacggccgtaacttccgaaccgtaacgttcctacccgaacggtaaccgtaaccccgttaacccaaacctaacgttaacccggtaccgttacggtaactacccgttaacctaaaagttacgtaaaaccgtagttacgggtacgtaaccgtaaggtttaacgaaacgtaacgtaaccggacttaaacgtttagtttaacgtttagtacgaacgtaaagttacgtttacggttaggtaacgtacgtaactaactaacgtaagtacggtaggtaacgtacggggtcgtaccgttaccggaaccgtaccgggtacgggtacccggaagggtaacccgtaccggtcggtacccgtaacccgttaccgtcccttaaccgaccgttcccgtacccgtaacccggtaacccgggtaccccttaaccgggttcccccgggttacccccgtttaccccccggttacggtaaccccccgttaacccccttaccccgtaacccggtaaacccggttacccgtaccccggtaaccccggg

SEQ ID NO: 44012 - DNA, 720 bp, Homo sapiens
  misc_feature: GYAE6OF02IYKXJ.31.14.B03.1.454.CMB.1.raw
  modified_base (190)..(190): a, c, t, g, unknown or other
  misc_feature (190)..(190): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagcgtgggttttcctcgttagctcttttaagaggtgtccagtgtcaggtgcacctggtggaatctgggggaggcgtggtccggcctggggggtccctgagactctcctgtgccatgtctgcgtctgaattcatcctnaggcactatggcagtgcacgtgggtccaccgaggccccaggcgaaagggtctgggagtggggtcgactatttanactaagtttgagtaggaagtaaacttaaaaaagtttcgactaagtaccgtaccggtagggaacgggtccgtaattaccactacttccgtaccaggaccgtaccccttaccaacctactaaccgtctcgtactctaactaaatacgaactgtacggtagactagtacgaacgtacacggacttaattattagttagtacgaagtaagtcgtttacggttgggtactagactacgtagacgttggtacggaggttacgggtgtcctacggaccgaacgggttcggggacgaagggtacctacggtcggtaccctaccgtcctcccgtacaccgtccgtaccccgtacggaaccggtccctaacggttccccggttaccccgtttaccccccgtggtaccccccctttacccccgttaccggtaaccccgtaacggtacccgtaccccgttacccgggg

SEQ ID NO: 44013 - DNA, 909 bp, Homo sapiens
  misc_feature: GYAE6OF02HIEYA.31.14.B03.1.454.CMB.1.raw
tcagcagtagacgtcacgaccggtgctcgatttagtgtgagtagtttgggctgagctgggtttcctcgttgctctttaagaggtgtccagtgtcaggtgcacctggtggaatcgtggggggaggcggtggtccgggccgtgggggggtccctggagactctcctgtgccatgtctgcgtctgaattcatcctcaggccactatggacatcgcacgtcggggcccgcccaacgggcccccaagggtccgaaagggggtcgtgggtaggtgggggtcggactagtttataactaagttttggatagggtaaagtaaattaaaaaagttttaacggcaagtaaccgttccggtaggtaaacgggccggtataccctaaccgatcctaccgaacgtaccggtaacccccttacccgaaaaccctagtaaccgtcctttacgggtaaccttactaacccctaaaattaacggtaaacccaagtttacggggtacggtaaacgtaagggtttaaagaaaccgggtaacctaaccggggtaaccctaaaaggttttaacctttaaaggtcggtttaacggaaccggaaagtttaacgttttacggggttttcgggtacccgttaaggggtaccctaagttaaccgtaaagtttaggggtttaggaacgggtttaaagggggttccggtacgttaaccgtaacccggaccggttaacgggggaacccgggaacggggtaaaccgtaccggttaggggtaaccccgttaaccgtccgtttcccaccggtaaccgccctaccggaaccccggtaacgggccccggttaaccggttacccggttccccgttacccccggttacccggtccctaaccccccgtttcccgaaccctaaaccgggcctacccgtaaccccggg

SEQ ID NO: 44014 - DNA, 781 bp, Homo sapiens
  misc_feature: GYAE6OF02IB2E1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggcctggggggtccctgagactctcctgtgccatgtctgcgtctgaattcatcctcaggcactatggcatgcacgtcgggtccaccacggccccagggacgaagggctgggagtcggggtggctatttaacacgtaattttggaactagggaaagtaaattaaaaaaaacgttttacgacaaggaccttaccggttggaaacgggggcctaactttccaacccgtattccgtccaaggtacgtaaccccttacccgaacctaaccttaaccggcttacggttactaccctaaaccgtaaaacgttacgaaaccaagttcggtacgaaccgtaaggtttacggaaacgtacgaaccggtaactaaaccgtttaattaaggtttacgtacgggtaaccgtaaaaggttacttttcgggttttaacgggttaccggtaacggtactacgtaacctaaggttgggtaaggttaagggtacgggtcggtaccgtcgaaccgtaccgggtcgggacgaaacgggaccacgttcgaccgtccgtcctccgacgtaccgccgtacccaaccggaacggccctaacggttccggtccccctttacccgtcgggacccttacccctaccctaacccgtaacgccgtaccgtacccgg

SEQ ID NO: 44015 - DNA, 649 bp, Homo sapiens
  misc_feature: GYAE6OF02GFD9H.31.14.B03.1.454.CMB.1.raw
  modified_base (373)..(373): a, c, t, g, unknown or other
  misc_feature (373)..(373): n is a, c, g, or t
  modified_base (525)..(525): a, c, t, g, unknown or other
  misc_feature (525)..(525): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcactgggtccgccacggccccaggcaagggactggagtgggtggctatttatacaatttgagtggagtaattaaaaaattttacgctagacctccgtaggaacgggccgattccaccgatcctacacccccgagaccccttaccaaccataccgctgtatcctaccaaatnaaacctagtggtcgactaggttagaacgaaccgaacggacctaaactttatttagttacgtagaacgtaaagtatttcggtttagggttcgagtctatacgtaatggtaggtagtagggtggctacgacgtaccggtggggaccagggaacncgttacggtcctaccgtcctcctacacgtccctacgaccgaacgggtccctacgttcccggtaccctttcccccgaggtacccctaccccttccccgttaaccaacggtaccgacctaacccgg

SEQ ID NO: 44016 - DNA, 860 bp, Homo sapiens
  misc_feature: GYAE6OF02H24QS.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactcctcctggtgccatgtctcgccgtctagtaattccattccctcgaaggcctaactagtcggacagtcgacacggttcgggcccacccgacggccccgagggaccggaagggtcgtaggggacggttggggtgacttaagtttataacgtaagtttgaaggttaggaagtaaaatttaaaaaagttttacgactaacggtaacgttccggtaggaaccgggacctaacttaccaacctacgtccgtaccgaacgtaaccgtaaccccttaccgaaacctactaaccgtacgttacgttactacctaacaaagtacgaactagttcggagtaacgtagttaacgaacggaaccgaacgtaacccttaaatttaagttacgtttaggtaacggtaacgtaaaacggtttcggttttcggttacgggtaccgtaggtactagtacgtaagttcggtagggttacgtaggggtcgaccgtacgtaaccgtaccgggttacggggaccggtaaacgggtaccgaaccggttcggtacccgtaccgttacccgttcccgtaacgtaccccggttacccgaccccgaaccgggttaaccccggggaaccccttccgggttccccggtttccccccggttaccccccgccggttaccccctaaccccccgttaccgtaaccccggtaaggacccgttacccgttaaccccgggg

SEQ ID NO: 44017 - DNA, 814 bp, Homo sapiens
  misc_feature: GYAE6OF02G99K5.31.14.B03.1.454.CMB.1.raw
  modified_base (271)..(271): a, c, t, g, unknown or other
  misc_feature (271)..(271): n is a, c, g, or t
tcagcagtagacgtcacgaccggtgctcgatttagtgtgagtagtttgggctgagctggttttcctcgttgctcttttaagaggtgtccagtgtcaggtgcacctggtggaatcgtgggggaggcgtggtccggccgtgggggtccctgagactctcctgtgccatgtctgcgtctgaattcatcctcaggcactagtggcatgacacgtcgggcccgccgacgggccccgaggacgaacgggacgtgggaggttgggtgtactaatttanactaattgagtaggaagtaaattaaaaagtttacgacgaagtaccgtaccggtaggaacgggtaccgtaacttccaacctacttacctaccgaacgtaaccgtaccccttacccgaacctactacgtcttcgtaaaaactcctaaaccgtaaagtacgaaactacggtacggtaacgtaacgtaacgttaacggaaacggtaacgtaaccggtaaccttaaacgtttagtttaacgtttaggtacgtaacgtaaacggttacgttttacgggtttacggttacgtacgtactaacgtacgtaagtaggttaggtaaggttacggggtcgtcgtaccgtaccggtaccgggtacgggtaccgaacgggtaaccgtacggttaccggtacccgtacccgttccctacccgtaccgtaccgtccccgtacccggaacccggtaacccgggtaccctaccggttccccggttaccccgttcccccggtacggtacccctaccccgtaccccgtaacccggtaaccggtacccgtacccgtaacccgg

SEQ ID NO: 44018 - DNA, 725 bp, Homo sapiens
  misc_feature: GYAE6OF02GIH19.31.14.B03.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggtccctgagactctcctgtgccatgtctgcgtctgaattcatcctcaggcactatggcatgcactgggtccgccaggccccaggccaaaggggacctgggagttggggtgctatttagtacaatttgatggagaattaaaaaatttacgcagactcgtgaagggccgattcacatcncagacaccttccaaccatacgctgtactctaccaaatgaactagtggtagactagttacggaacgacgaacgggtactaactttattatttaggtagacggtaaaagtacgttttaccgggtttagggtttaccgtaggtacctagttaaccgaaagttcggtagggtacgttaaggggtcggtacctacggacctaccgggtgggggtacccgaagggggtaacctaaccggttgggtacccgtaaccggtttcctacccgttaccgtaaccgtaccccgtacccgaaccccgtaaacgggggtcccccctaaaggtttccccggggtcccccgtttacccccccggtacgggtaccccctaacccccgttaccctacccggaacgtacccgcccgttaaccccgg

SEQ ID NO: 44019 - DNA, 752 bp, Homo sapiens
  misc_feature: GYAE6OF02GAFVX.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacgggccccaggcgaagggactaggaggtgggtgctatttatactaatttgataggaagtaattaaaaaagttttcgacggtaactccggtaggaacggggccgtattaccgaacctatcctaccaacggacgtaccccttaccaaacctataccgactagtactcctaaccaaatcgaaacctagtggtacgacgtagttacgaacgtacgaacggtacttaaactttaacttaagttaggtagtaacgtaaacgttacgttttacggttagggttacgagtactaatactaagttggtaggttaggtaggggtacgtacctacggaccgtaccggtacggggaccgaaggggaacctacggtacggtacccgtacccggttcctaccctaccgtaccgtacccctacccgaacccggtaaccgggtaccccttaacggttccccggttaccccgtttacccccggtaccggtaccccctacccccgtttacccgaaccgtaacggtaccgaccccttaccccggtaccgggg

SEQ ID NO: 44020 - DNA, 758 bp, Homo sapiens
  misc_feature: GYAE6OF02I5UUR.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcgaggcactagtggcatgcacgtcgggtccnccacggccccaggtccaaagggctgggaggtggggtcgctaatttacacgtaagtttgagttaggaagtaaacttaaaaaaacgttttcgacgtaacgtacgttaccggtaggaaacgggtccgtattaccgaacctactcctaccgaacgaccgaaccccctaccaacctactacgtctacgtactccgtaaccaaagtacgaactagtacggtactacgtagtacgaacgtacgacgtactaactttagtacgtgtacgaacgtaagttagtttcggttaggttcgacgtactaatacgtaaagttcggtaagggtaggttaggggttacgtaccggtaccggtaaccgaccgggtacgggtaaccggaacgggtaaccgtacggtacggtaccgtacccgttccgtacccgtaccgaccgtcccgtacccgaaccggtaccgggtccccgtacgtttcccggttacccccgttaccccgttacggtaccccttacccgtaccccgtacgtaaccggaccgtaccccgtaacccggg

SEQ ID NO: 44021 - DNA, 871 bp, Homo sapiens
  misc_feature: GYAE6OF02ISTGJ.31.14.B03.1.454.CMB.1.raw
  modified_base (586)..(586): a, c, t, g, unknown or other
  misc_feature (586)..(586): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctgagactctcctgtgccatgtctgcgtctgaattcatcctcaggcactatggcatgcacgtcgggtccgccagggcccctacggacggaacgggaacggtcggtagggtgggtcggggtcgtaacgttttaattaaactaaacgttttaaggttagtaagggtaaggtaaaattaaaaaaagtttttaaaaccgtacgaacgtaacgtaccggtacggaaacggggtacccggacttacctaaccgaactaccgtaccgacgaacgtaccccttaccctaaccaactacgtactacgtactacctacctaaacgtaacgtaactaagttaggtacgtaacgaagttaacggtaacgaaacgacggtaaccgttaaacttaagttttacgtttaggttacgaagtaaaacggttatttccgggtttgggtttacgggtanaaccgtattacgtaaagttaggtaggggttaagtaggggttccgggcttaccgggaaaccgcccgggtagggggtaccccgaaaggggtaaccgtacccgttcgggttacccgtaacccgtttacccgtccttaccgacgggttacccccttacccggaacccccgaaaacggggggtttccccaaccgtttcccggggtttaccccctttcccccggacccggggtacccttaccccccttacccccgttaaccgggaaaagtccccgggaccctacccccggg

SEQ ID NO: 44022 - DNA, 756 bp, Homo sapiens
  misc_feature: GYAE6OF02H3NQT.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcgtggggggtcctgagactctctgtgccatgtctgcgtctgaattcatcctcgaggcactagtggcagtgctacggtcggggtcccgccgacggccccagggaccgaaagggtcgtgggaggtggggtcggctaagttttactacgttaatttggagtagggaaataaaaaagtttaaaaaagttttcgacgtaaacgtaccgttaccggttacgggaaacggggacccttaattacccaacctacttaccgtaccgaacggtaaccgtaaccccctttacccaaaaccgtagttaaccggcgttacgttaactaaccgtaactaaaacgtacgaactaggtcggtagaactaggttaagaacgtacgaacgtctaaactttatagttggacgaacgtaaagttgggttacggttttagggtacagtccgtaagttactaagtggtaggtaaggtaggggtctcggtaacaccgtacgggacgggtaccggaaggacgacgttggtaccctaccgtctcctacgccgtcctacccgaacggaccgtccgtacgttccccggtcctttccccccggagccccgttacccctaccgttaacccgaagtcccggactacccggg

SEQ ID NO: 44023 - DNA, 902 bp, Homo sapiens
  misc_feature: GYAE6OF02G9SCP.31.14.B03.1.454.CMB.1.raw
  modified_base (188)..(188): a, c, t, g, unknown or other
  misc_feature (188)..(188): n is a, c, g, or t
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactagtggcatgcacgtcgggtcccnccgacggcccccagggccgaagggtactgggaggtcggggtgctatttatactaatttgatggaagtaattaaaaatttcgactaacgacctcggtaggaacgggccgtacttccaacctatccgtaccgaacggaccgtaccctttacccaaacctaacgtaccgtacgttacgttaacttaccttaaaccaaagtacgtaaaccgtacgtttacggggtaacgtaaccggtaaggtttacggaaaccggtaaccgtaaccgggtaaccgttaaacgttttaagttttaacgtttacgggtaacggtaacggttaaaacggttacggttttacgggtttacgggttaccggtaatcgttaaacttacggtaaacggttgggttacgggtaagtttacgggggtaccgaaccgttacccggaacccggtacccggggttcgggggaacccggtaacggggtaacccgtaccgggttaccgggttaacccgttaacccggttacccgttacccgttaccgaacccgtcccccttaacccggaacccgggtaccccgggtacccgttaacccggttttaccccggggttaccccctttaccccccgggttaccggtaccccccgttaaccccccgttcccggtaaacccggttaaccccggaccggttacccccttaccccggggg

SEQ ID NO: 44024 - DNA, 683 bp, Homo sapiens
  misc_feature: GYAE6OF02IG47C.31.14.B03.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggcccccaggacaagggactggacgtgggtggctatttanactaattttgatggaagaataaaaaattttacgacagactcgtgaaggccgattcaccatctaccagcgacccttccaaccatacgctagtatctaccaaatgaacataggtagacagttagaagacaacgacaactttattattgtagacgtaaagtacttcggttaggttacgagtactagtacaaagttggtaggtaagttaggggtcgtacgttaccgaacgtaccggtcggggaccgtaaggggaacctaccggttcggtaccgtacccgttcgtacccgtacctaccgaccctaccccgaacccgtaacggggtcccctaacgttccccgggttaccccgtttaccccccgttacgggtccccctaacccccgttacccgtaaccccgaaacggtacccggtacccgttaacccccggg

SEQ ID NO: 44025 - DNA, 847 bp, Homo sapiens
  misc_feature: GYAE6OF02HSCKY.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggatcgtgggggaggcgtggtccggccgtggggggtccctgagacctctcctgtgccatgtctcgcgtctgtaattcatcctcaggctactagtcggctatcgaccacggtcgggtcccgaccgaccggcccgagggaccgaagggcgtgggagggttcgggtggtacttatttactaacgtatttggaagtggtaaataaaagttaaaaacgtttccgacgtaagtaccgtccggtaggaacgggtcctaacgtaccacctacttccgtaccgaacggtacctaaccccttccgaaaacctcgtaccgtacgttagtaaccttacctaaccgtaaagtaccgaacgtagtcgggtaagacgttacggtagtaaacgaccggtaacgtaaccttaaagtttcggtttagttacggtaacggaacggttaatttacgggtttaccgggttaggtacggacctagttaactaccggtaaaggttcggtaagggttaccggttgggtaccggtaccgttaacggaacccggttacccgggtcggggtaacccgaaaggggtaccctccgggtttacggaaccccttcccgggttacctaccctacgggtacccctacccgtaaccccggtaccgggtaaacccggtcccgttaccggtttacccccggggttcccccttaccccgggactacccccttcccccggtaacgttacccgaaccggtcccggactcccccgggg

SEQ ID NO: 44026 - DNA, 848 bp, Homo sapiens
  misc_feature: GYAE6OF02I2S3P.31.14.B03.1.454.CMB.1.raw
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcggggtccgccacggccccaggccgaaaggggactgggaggtgggtggctatttanactaatttgatggaagtaattaaaaaattttacgacagactaccggtaggaacgggaccgtattaccacctatctaccgacgacgtaccccttacccaacctactaaccgcttacgtacttacctacccaaaagtacgaaactagtagggtacgaacgtaggttaacgaaacgtaaccgaacggtacctaaacgttttaagtttaacgtttggttacggtaaccggtaaaaaggtttacgttttacgggttttacggggtttaccggtaaaggtaccgtaacgttaccgtaaagttagggttacgggtaagggttaacggggttcggggaaccttccgggaacccgtacccgggttacgggggaccgtaacgggggtaaccctacgggtccggttacccgacccgttaccgtacccgttaccgaccgtaccccttacccgaacccggtaacccggggtcccccgtaacggtttccccggggtttccccccgtttaccccccggttcccggtaaccccccgttacccccgttaaccccccggtaacccggtaaacccggtaccggtacccccgttacccccggg

SEQ ID NO: 44027 - DNA, 794 bp, Homo sapiens
  misc_feature: GYAE6OF02GSITX.31.14.B03.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcagtgcacgtcgggtcccgccacggccccaggtacgaagggactggaggtgggtggactaagtttataactaagtttgagtaggaacgtaaaattaaaaaagttttccgacgacgtaaccttccggtagggaacgggaccgtattccgaaccctatcctaccgagaccgtacccttaccaacctagtaccgcttacgtacttcctaaccaaacgtanaaactgtggtacgacgtagttacgaaacgacgacggacttaaactttagttattaggtcgaacgtaaaggttcttttcggggttaggtttacggaactagtaacttacggtaaacgttgggttaggaagggtttacggggtcgtaccgtaccggacccgtaccgggttacgggggaccgtaaacgggaacctacggttacgggtcccgtaacccgtccgtttacccacgtacccggacctaccccggtaacccgaaccgggggtccccttaaccggtttcccggttcccccccgttttccccccggtagggtaacccccctcccccgtttaacccccgttaacgaacccgggtacccggttaccccctaaccccggggg

SEQ ID NO: 44028 - DNA, 878 bp, Homo sapiens
  misc_feature: GYAE6OF02HADES.31.14.B03.1.454.CMB.1.raw
  modified_base (65)..(65): a, c, t, g, unknown or other
  misc_feature (65)..(65): n is a, c, g, or t
tcagcagtagacgtcacgaccggtgctcgatttagtgtgagtagtttgggctgagcgtggtttcncgttgctctttaagagtgtccagtgtcaggtgcaccgtggtggaatcgtgggggacggcgtggtccggccgtgggggtccctgagactctcctgtcgccattgtctgcgtactgtaacttcatcctcgaggctactagtcggcagtcgcacgtcgggtccgaccacggtaccccaggacccgaaagggggtctggggtaggttggggttcggtacttacttttacgtaaacttaagtttggaagtaggtaaacgtaaaatttaaaaaacgtttccgacgaaggtaccgtaccggttaagggacgggtacccgtatttacccgaacctactccgtaccgacggtacctaccccttaccaactacgtcgacttacgtactccctactaaagtacgtaacgagtaggtacgaacttagggtaacaaacggtacggaaccgtaaacctttaaggttactttaagtttcggtaaccggtaacttaaacggtttaccggttttcggtttaaccgggttaagaccgtgttaaaccgttgtagtttacggggttagtaacggtcggggtaccgttacgtaacgtacccggtacgggggtaccgtaaccgggtaaccgggacttaccgggggtaccgtttacccgccgttaccccgttaaccgccgtacccgttacccgttaaccccgggaaccggtaaccccggggttccacccggggttttccccgttccccccggtttacccccgtacggggttacccccctttaaccccggccgttttaaaccccggaacgttaccccggggtaaccttacccggggg

SEQ ID NO: 44029 - DNA, 613 bp, Homo sapiens
  misc_feature: GYAE6OF02IE0PG.31.14.B03.1.454.CMB.1.raw
  modified_base (216)..(216): a, c, t, g, unknown or other
  misc_feature (216)..(216): n is a, c, g, or t
  modified_base (516)..(516): a, c, t, g, unknown or other
  misc_feature (516)..(516): n is a, c, g, or t
  modified_base (579)..(579): a, c, t, g, unknown or other
  misc_feature (579)..(579): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcgaggcactatggcatgctacgtgggtccnccaggccccaggcaaggactggagtgggtgctatttatactaatttgatggaagtaacttaaaaaattttacgactaagtacctacgtaggaacggccgtattccaacctatcctaccagtacgtacccttaccaacctataccgctacgtatacctactaaatacgaactaagtggtagacgtagttagaacgacgtacgactaaacttattagttgtagaacgtaagtattacggttgtacgtagcaatcgaagtgtaggtagtaggtgtccgtagacacggtggaccgaggtaaccngtcggtacaccgtcctcgtacacgtcctaccgaccgacggcctacgtccggtcccgttccccngtaccctacccgtcctacgaacgtcaccgtaccg

SEQ ID NO: 44030 - DNA, 766 bp, Homo sapiens
  misc_feature: GYAE6OF02H8TBJ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcacttatggcatgcactgggtcccgccaggcccccaggacaaggggactgggtaggtggggtggctatttacgtactaatttgagtggaagtaaattaaaaaacttttacgacagtacgtccgtaggaacgggcgtaattccaaccgacttaccgtccaacggacgtaccccttacccaaaccagtaaccgcttagtactaccgttacctaaaatcgaaacctagttacgggtagtaaccgtaaggttacgaaaacggtaccgtaacgggtactaaaacctttagtttaagtttggttacgaacgtaaaaggttacgttttacggtttacggggttacgtaacggtacaattactaaagttggtagggtaagttaggggtcggtaccgtacgacgacccgggtcggggaccgagggtaaccgtacgttcggttaccgtaacccgtcccgttacctaccgtacgtccccgttaccgaacccgtaacgggccccgttaacggttcccgttaccccgttcccccgttcggacccttaacccccgtccttaaccccgaacggtaccgtccctaacccgg

SEQ ID NO: 44031 - DNA, 788 bp, Homo sapiens
  misc_feature: GYAE6OF02IDF41.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcactggtggaatctgggggaggcgtggtccggcctggggggtccctgagactctcctgtcgccatgtctgcgtctagaactttcattccctacgaggaccactagtggacatgactacgtcgggtcccgccgacggccccgaggcgaagggcgtggaggtgggtgactattacactaagtttgagtggaagtaaagttaaaaaacgttttcgactagtaacgttccggtaggaaacgggccgtaagttaccaaccgtaacttcctaccgaacgaccgtaaccccttaccgaaacctaacgtacgaccttacgtaacttaccgtaacctaaataacgtaacctagttacggtaggaacctaaggttaacgaaacggtacgaacgtaacgttaactttaaattacgtttggtacgtaacgtaaagttacgtttacgggtttggtacgtaacgtactacttaacgtaaagttggtaagggttaggtaacggggtcgtacggtacccgacggtaccgggtacggggtaccgaacggggaactaccgggttacggacccgttaaccgtccttacccgtaccgtacctaccccgttacgaacccggtaacgggtccctaacggttcccgtccccgtttccccgacggtaccctaccccgtaccttacccgaacgtacccgtacctaacccggg

SEQ ID NO: 44032 - DNA, 825 bp, Homo sapiens
  misc_feature: GYAE6OF02GG7IL.31.14.B03.1.454.CMB.1.raw
  modified_base (427)..(427): a, c, t, g, unknown or other
  misc_feature (427)..(427): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcaaaggggctgggacggttgggtggactaattttagaacttaagtttgagttaggaacgtaaattaaaaaaattttcgacacgtacctccggtaggaacggggcctaagtttccaaccctagttcctcccgtaacggacgtaccccctttaccaacctataccgcttgtactaccgtaccaaatcgaaactagtggtanacgtagttagaacgacgaaccggtactaactttagtttagtcgtagtaacgtaaaagttacgtttcgggtttagggttttaccggaacgtacgttaacgtaacttaaaggttgggttacgggttaaaggtttgggggttacggtcccgttaacggtacccggtaaccgggttcgggggaacccggtaaaggggaccctaaacgggtttccgggtaacccttaccgggttaccccctaccgttaccgacccggtacccccttacccgaaccgggaacccgggtccccgttaacccgttcccccggggttttaccccctttccccccgggtacggtaacccccctccccggtttaacccccgtaaccgaacccgggtaccgtaccccggttaaccccggg

SEQ ID NO: 44033 - DNA, 727 bp, Homo sapiens
  misc_feature: GYAE6OF02G50V4.31.14.B03.1.454.CMB.1.raw
  modified_base (556)..(556): a, c, t, g, unknown or other
  misc_feature (556)..(556): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccgaggcccccaggcaagggctgggagtggggtggactagtttatacgtaatttgagtggaagtaattaaaaaacgttttacgactaagtaccgtaccggtaggaacgggccgtaattaccacctatcctaccgagtaccgtacccctttacccaaacctactaccgcttagtactacctaccaaagtacgaactacgtggtacgaccgtaaggttacgaaagtaccgaacggtactaaacgtttatttagtttaggtagaacggtaaagttacgtttacggttgggttacgagtactatacgtaagtggtaggtaagtacgggtggtcctaccgggaccnccgggtacggggacccgaagggacctacgttcggtacctaccgttccgtcctaccgacgtacccttacccgaaccgtaaccgggtcccctaaggttccccggtacccttccccccggtggaccccttaccccgttacccgaccctaaccggtaccgtacccgtaccccggg

SEQ ID NO: 44034 - DNA, 567 bp, Homo sapiens
  misc_feature: GYAE6OF02GEXAF.31.14.B03.1.454.CMB.1.raw
  modified_base (409)..(409): a, c, t, g, unknown or other
  misc_feature (409)..(409): n is a, c, g, or t
  modified_base (467)..(467): a, c, t, g, unknown or other
  misc_feature (467)..(467): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggataataaaaaattttcgacagactccgtagaagggccgtattccaccatcctccagacgacccttaccaaccatacgctgtatctacaaatgaacagtgtgactagttgaagacacggactaacttattattgtgacgaaagtnttcgttggtcgatcatcaagtgtaggagtagggtgctcgacgacgtgggacagggacncgtgtccaccgtctccgtcacgcccaccacgacggcccagttcccggtcctttcccccgnggtacccctacccgtccctaccgaacgaccgcctacccgg

SEQ ID NO: 44035 - DNA, 676 bp, Homo sapiens
  misc_feature: GYAE6OF02IGW6M.31.14.B03.1.454.CMB.1.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggctgggggtcctgagactctcctgtgccatgtctgcgtctgaattcatcctacgaggcaactagtggctatgcacgtcgggtcccncgacggccccaggacgaagggctggagtgggtagctatttanactaattgataggacgtaaattaaaaagtttacnagtactacggacggacggcgtactccactatctcacgtaccgtaccctacacctagtacgtactagtactcctaaccgtaaatacaactagtggtacgatagttagaacgacgacgtaactaacgttattacgtagtacggaacgtaaagtaagtttcgggttaggttacgactcgtataacgtagttaggtacggtaggttagggtacggtaccttacggacctaccgggtagggaaccggtaaggaaccgtacgtcgggtacccttacgttcccgtaccttccgaaccgttcccacccgtacggaacccggtcccgtacgtacccggtcccttccccgacgtccctaccccgtcctaacccgacgtacgaccctaccgg

SEQ ID NO: 44036 - DNA, 844 bp, Homo sapiens
  misc_feature: GYAE6OF02I1JDN.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgctactgggtccgccaggccccaggccaaagggctgggagtgggtggctagtttatactaatttgattggaagtaattaaaaaattttccggacaaggtacctaccggttaggaacggggacccgtaacgtttaccaacctagttcctaccgaacggtaaccttaacccccgtttacccaaaaccctaagttacccggtaccttaggttaacttacccttacccgtaaaagttaccgaaactaagttccggggttagtaaacgttacggtttaacggaaacgtaaccgtaaccgggtacctaaactttaacgttttaatacgggttaacgaccgggtaaaaacggtactttttccggggttttagggtttaccgtaaggtacttaaccttaacgtaaacgttgggttacgggtaaacggtttacggggttacgggccccgttaacgacccgtaccgggttacgggggcccgtaaaggggtacccaaccggttcgggtacctacccgttccgtacccgtacgtccgtaccccttacccgaaacccggtaccgggtacccctaaggttccgggtaccccgttttccccgacggtcccgtaacccccttccgtaacccgtaacggtacccgtacccgttaccgggg

SEQ ID NO: 44037 - DNA, 770 bp, Homo sapiens
  misc_feature: GYAE6OF02GJJ2B.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtccgccacggccccaggcaagggctggagtgggtgctatttanacatttgatggagtataaaaatttcgcagactccgtagaaggccgattcacctatctacagacgtacccttacaaccatacgctgtactcctaccaaatagaaacctagtacgggtacgaacgtaaggttacgaaacgtaaccgaacgggaccttaaactttactttaacgttcgtacggtaacggtaaaagtcggttttcggtttaaggggtttaccgaaggtacctaaacgtacgtaaagttcgggttaagggtaacggttaacgggggttcggtacccttacggaaccgtacccgggttcggggggtaaccccgaaagggggtaaaccctacggtttacgggtacccgtaacccggttccttcccggtaccgacccggttaccccgtacccgaaaccccggtaaacggggtcccctaacgggttccccgggtttaacccctttcccccccggtagggaccccctaccccctttacccggtaacccggaaacgaccggtacccctaaccccggg

SEQ ID NO: 44038 - DNA, 832 bp, Homo sapiens
  misc_feature: GYAE6OF02JEAZM.31.14.B03.1.454.CMB.1.raw
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggagcgtggtccggcctggggggtccctgagactctcctgtgccatgtcngcgtctgattcatcctgagcactagtgcatgctacgtcgggtccncgacggcccaggcaagggctggagtgggtagctaatttanactagtttcgagtggaataaattaaaaacttttcgacgtagtaacccgttccggtaagggaacggggtaccctagtttacccaaccgtacttcccgtaccgaacggtaccggttaaccccccttaccaaacccgtacgttaacccgccgtttaacggttaccttacccgtaaccctaaagtacggtaaaacccgtaggttcgggtaacgtaaacgtacgggtttaagaaaccggttaaccggaaccgggtaactttaaaaccgttttatttacggtttaggtacgtaaacggtaacgttacggtttacggtttacggttacgaagtactacgtaactaagttacgggtaggtaacggttgggtacggaccgttaccggacgtaccgggtagggtccgaaacgggtacgtaccggtcgtaacccgttccgtcccttacccgtcgaccgttccccgtaaccgtacccggtacccgggtcccttaacgggttcccccggtttccccgttaccccccgttagaccccccggttaccccgttaaccccgtaaccggtaccggtacccggtaccgttaccccggg

SEQ ID NO: 44039 - DNA, 675 bp, Homo sapiens
  misc_feature: GYAE6OF02H9ZAI.31.14.B03.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctgagactctcctgtgccatgtctgcgtctgaattcatcctcaggcactatggcatgcactgggtccnccacggccccaggcaaagggctggagtgggtgcatttanactaatttgatggaagtaataaaaatttacgcagactcgtagaaggcgtattcacatcgtaccaggactacccttacaaccagtaccgcgtagtactcctaaccaaaagtcgaaactagtcggtacgaacgtaagttacgaaacgacgaacggtactaaacgtttattagttagtagaacgtaaaagttacgtttacggtttgggttacgagtctaaacgtataagttggtaggtaagttaggggttacgccttacgaccgtacggtcggggacccgaaagggactaacgtcggtaccgtacccgtaccttccacgtaccgccctacccgaaccgaaccgggccctaccgttccggttaccccgttccccgtcggtaccctaccccgtaccgttaacccgaacgtccgtacccgtaacccgg

SEQ ID NO: 44040 - DNA, 606 bp, Homo sapiens
  misc_feature: GYAE6OF02FUZ32.31.14.B03.1.454.CMB.1.raw
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
  modified_base (596)..(596): a, c, t, g, unknown or other
  misc_feature (596)..(596): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtgcatttatacaatttgatggagaataaaaaattttacgcaagactccgtggaagggccgattacaccgatcctaccagaacgtaccccttaccgaaaccactaccgtactgtactctaccaaaatgaaacatagggtagactagttagaaaggtacacggacaaacttatttaacttgtagtacgtaaagtactttcggttaggttgagtcagtacaagtggtaggagtagggtgctcgacacgtcgggccaagggacngtcggtcaccggtctcctcncgtacctccgacgaaccgggtcctacgttcccggtcccttacccccgtgcccgaccccttccacccgacgacncccgtaaccg

SEQ ID NO: 44041 - DNA, 796 bp, Homo sapiens
  misc_feature: GYAE6OF02IMZEZ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggggaggcggtggtccggccgtggggggtccctgagactctcctgtgccatgtctgcgtctgaattcatcctcaggcactatggcatgacacgtcgggtccgccgacggccccgagggaccgaaacggggtaccttggggaggtcgggggttggacctaagtttttaactaaccgtaaagttttaggaagttaggggtaaagtaaaagtttaaaaaaaacgtttttaaccggaccgtaacggtaaccgttaccggtacgggtaaacgggggaccgtaacgtttaccgaaccctaacttacccgtaccgtaacggaaccgtacccccgtttacccaaacccgtactaccgtacgttacgttacttacctaaccgtaaattacgaaactagtaggtacgacgtaagttagaaacgtacgaacggactaaactttagttaagttacgtagaacgtaaacgtacgtttcggtttcggtacgtacgtaacgtacgttcaagttggtaggtaaggttaggggtacggtaccgttcgaccgtaccggtcggggaccgaaggtaacgacgtacgggtaccgtaccgtctacccgacgtacgccgtacccgaccggaccggccctagttcccgtccgttaccccgtcgtacccgtaccctaccgtaccgaacgtacgcctacccggg

SEQ ID NO: 44042 - DNA, 728 bp, Homo sapiens
  misc_feature: GYAE6OF02HPD5R.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggccactagtggcatgctacgtgggtccnccacggcccaggcaagggactggaggtgggtgctatttatacaatttgatggtaagtaattaaaaaattttcgacaagtactccggtaggaacgggccgtattacaacctactccgtccaagaccgtaccccttaccaaccctactaccgacgttacgtactacctaactaaattacgaactacgtgggtacgaacgtacggttaagaaacgtacgaacggtaactaaacttttaagtttacgtttaggtaggtaacggtaaaacggttacgtttacgggtttaggttacggaacggtactaacttacgtaaagttggtagggtaaggttacggggtacggtccgtacgaccgtaccgggtcggggaccgaacggggaactaccggtcggtaccgtaccgttctccctacgtaccgtcctacccgaacggtaccggtaccgtccgtaccggttccctcccgttaccggtacccctaccccgtaccctacgaacgtaccgccctacccggg

SEQ ID NO: 44043 - DNA, 800 bp, Homo sapiens
  misc_feature: GYAE6OF02IAU3Q.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtccncgacggcccaggcgaagggctgggaggtgggtgctagtttatactaatttgagtaggaagtaaattaaaaactttcgactaagtacctccggtaggaacgggccgtaactttaccaacctattccgtaccgaaggtaccgtaacccccttccaaacctactaccgtcttacgtacttacctaacctaaaagtacgaaactacgtggtacgtaaccgtaggttacggaaacgacgtaaccggtaaccttaaagtttacgttagtttacggtacggtaacgtaaacggttacgttttacgggtttcggtaaccgtagtaccgttaatacgttaaggttggtaaggtaacggttaggggtacgtacgtacggtacgaccgggttacggggaccgtaacgggaaccgtacggttcgggtaacccgttacccgttaccgttcccgtaccgtaccgtaccccgttaccgaacccggtaaccggtcccttaaccgggttcccggttacccccgtttacccccgtacggtaccccgttacccccgtaccccgttaacccggaaccgtaccggtacccgtaacccccgggg

SEQ ID NO: 44044 - DNA, 669 bp, Homo sapiens
  misc_feature: GYAE6OF02GWQUG.31.14.B03.1.454.CMB.1.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (378)..(378): a, c, t, g, unknown or other
  misc_feature (378)..(378): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatcctcaggcactagtggcatcgcacgtcgggtccnccacggccccaggcaagggctggagtgggtgctattanactatttgatggaagtaattaaaaaagttttcgacagactaccggtaggaacggccgtattcacctatcctaccacgacgacccttaccaacagtaccgctagtactctacaaatacgaanacgtggtacgacgtagttagaacgaacgaccgtataactttattattggtacgtaacgtaaagtacgtttcgggttacggttcgaagtactaacgtactaacgttggtaggtaaacggttcggggtacgtaccgttacgaccgtacgggtacgggaccgtaacgggacctacggtcgtaccgtccgtcctacctacgacccgtcctacccgaccgacgggtccctacgttcccggtacccttcccgtcccggtacctaccccgtccgtaaccacgacccgtacctacccgg

SEQ ID NO: 44045 - DNA, 544 bp, Homo sapiens
  misc_feature: GYAE6OF02FGCTE.31.14.B03.1.454.CMB.1.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
  modified_base (468)..(469): a, c, t, g, unknown or other
  misc_feature (468)..(469): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggctggagtgggtggctatttatacaatttgatggagattaaaaatttcgcagactccgtgaagggcattcacatctccagacgacccttccaaccatacgctgtatctccaaatgaacntggtgacagttagaagacacggcaacttattatgtgacgtaaagnttcgttggttcgagcatcaagtgtgagtagggtgctcgacnccgtggggccagggacacgtgccacgtctccnncgcctaccaccgagggccctagtcccggttccttcccccgnggccctacccctcctaccacgacgtccctacccg

SEQ ID NO: 44046 - DNA, 829 bp, Homo sapiens
  misc_feature: GYAE6OF02JM56C.31.14.B03.1.454.CMB.1.raw
  modified_base (268)..(268): a, c, t, g, unknown or other
  misc_feature (268)..(268): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtcagaattcatcctcgaggcactatggcatgcacgtgggtcccgccgacggcccccaaggccgaaaggggcctgggaggtgggtgactagtttanacaatttgataggaagaattaaaaaacttttacgctaacgacgttccggtaggaacggtccgtaattccacctactcctccaagacgaccccttaccaacctactaccggtcttacggtactccgtaaccctaaagtacgaaactagttcggtacgaactaggttacgaaagacccgtaaacgggtaccttaaactttacgtttagtttacggtagtaaccggtaaaaggttacgttttacgggttttacgggttaaccggtagtaccgtaagttaccgttaaaaggttcggttaagggtaacgttagggggttacgtacccggtacgtaaacccgtaccggggttcggggtaaacccggtacggggtaaacctaccggtttcgggttaacccgtcccggtttaacccttcccgtaccgtaccggtaccccgttacccgtaacccggaacggggtacccccttaaggttcccccggtttacccgttccccccggttaccggtacccccttacccccgttaccccgtaaccggtaacggacccggttacccccgttacccgg

SEQ ID NO: 44047 - DNA, 616 bp, Homo sapiens
  misc_feature: GYAE6OF02HXMV8.31.14.B03.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (482)..(482): a, c, t, g, unknown or other
  misc_feature (482)..(482): n is a, c, g, or t
  modified_base (577)..(577): a, c, t, g, unknown or other
  misc_feature (577)..(577): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtcctgagactctcctgtgccatgtctgcgtctgaattcatcctcaggcactatgcatgcacgtgggtccnccaggccccaggcaagggctggagtgggngctatttanactaatttgatcgganaaataaaaatttacgacagactcgtagaaggcgatcacatcacagacacctcaacatacntgtatcacaaatacacagtggtanacgtagtagaacgacacggactaaatttattagtttagagtaacgtaaagttactttcgggttagtaccgagtaccaagttactaacgttgtaggtaaggttacgggacgtcgtaacgtacggtaaccggnggggaacccgtaagggaaccctagtcggtacacccgttcacctcgacgtccctaccgaacccgacggtaccctaacgtccgttcccttaccccgnggtccctacccgtccgtaacgaacgcgtaccctaccggg

SEQ ID NO: 44048 - DNA, 775 bp, Homo sapiens
  misc_feature: GYAE6OF02IG1QC.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggccgtgggggtccctgagactctcctgtgccatgtctgcgtctgaattcatcctcaggcactatggcatgcacgtcgggtccgccacggccccagggcaaggggactgggagtgggtgctatttacactaatttgatggaagtaaattaaaaatttcgacagactccgtagaacgggcctattacactattcctaccgaagaccgtaccccttaccaaacctacgtaccgccttacgtaactccttaaccaaagttacgaaactaagttcgggtaacacgtaaggttacggaaacgtaccgtaacggtacttaaacgtttatttaagttgttacggaacggtaaaggttacgttttacgggttcgggtttacgacggtaactaacgtacgtaagttgggtaaggtaacggtttaggggtacggtacccgtaccggaacctaccgggttacggggacccgtaaggggtaaccttacggttccggggtaacccttacccggttccgtacccgtacgtaccgggtaccccttacccggaaaccggtacccgggtccctaaccgtttccccgggtaccccctttccccggacgtaccccgtaacccctttcccgaacccggtaaacgcccgtaacccggtaccccgg

SEQ ID NO: 44049 - DNA, 820 bp, Homo sapiens
  misc_feature: GYAE6OF02FOXIJ.31.14.B03.1.454.CMB.1.raw
  modified_base (188)..(188): a, c, t, g, unknown or other
  misc_feature (188)..(188): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggctactatggcatgcacgtcgggtccnccacggccccgaggacgaagggctggaggtgggtgactaagtttanaacgtatttgagtaggaagtaaaatttaaaaaaacgtttccgactaacggtaccttaccgggtaggaaccggggtccctaactttaccgaacctactcctaccgacggtaaccgtacccccttaccgaaaccctagtaccgtcttacgtactcctaaccgaaagttacgaaactagtacggtagaaccgttaggttaacgaaacggaacgtaaccggtacttaaacgtttagtttacgttggtacggtaaaccgttaaagttacgtttccggggtttacggtaccgaagtaccttaagttacgtaaaggttcgggttaaggttaagggttaccgggggtacgtaccgttaccggtacccggtaaccgggttccggggaacccggaacgggttaacccgtacgggtttaccggtacccgtaaccccggtttcctacccgtaccgtacccgccccgttaaccggaaccccggtaccggaccctttcccggtaccccgttcccccttccccggcgtaccccctaccccgttaccgacccgacgtaccgtccctacccggg

SEQ ID NO: 44050 - DNA, 687 bp, Homo sapiens
  misc_feature: GYAE6OF02FWV0R.31.14.B03.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcactgggtccnccacggccccaggcaagggctggagtgggtggctatttanactaatttgatggagtaattaaaaaattttacgacagactcgtaggaacgggtccattcgaccatcctaccagacgacccttcaaccatacgctgtatcctacaaatcaaactagtggtagactacggttagaacgacgacggactaaacttattattaggtagacgtaaagtgttttaccggttagggttaccgtaaggtctaagtacctaaagttggtagggtacgtaggggttcgtaccgtccgaaccgtacccggtggggacccaaggggtaccacgttcgggtacctacccggttcctacctaccgaccgtacccgtacccgaacccgtaaccggggtacccacggttccccggttacccgttaccccccgtggacccccgttaccccggtacccttaccccggaaacgtccggacccgtaaccccgg

SEQ ID NO: 44051 - DNA, 726 bp, Homo sapiens
  misc_feature: GYAE6OF02FZKQ2.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (463)..(463): a, c, t, g, unknown or other
  misc_feature (463)..(463): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggcctggggggtccctgagactctcctgtgccatgtctgcgtctgaattcatcctnaggcactatggcatgctactgggtccncacggccccaggcaaggctggagtgggngctatttanataattgatggagtaataaaatttcgacagtactccgtagaacgggccgtattccgacctagttcctaccgaagtaccgtaccccttaccaaacctagtaacctcgttacgttacttccctaaccgaaacttacggaaacttacgttagggttaacgaacggttacggtttagaaacggtaaccgtaaccgggtaacttaaaaccgttttnttaacggttttacggacggtaacggtaaagttacgtttaccgggtttacgggttacggacgtacgtaacttaccgtaagttcggttagggttacggtaaggggttcggtacggttacacccggtaccggttcgggaccggtaacgggacctacgtcgggttaccaccggttcctaccgtcacgtccctaccgaccgacggccctacgttcccgtacccttacccgtcgccctacccgtaccctaccaacggtccacctcccgg

SEQ ID NO: 44052 - DNA, 715 bp, Homo sapiens
  misc_feature: GYAE6OF02FOQCE.31.14.B03.1.454.CMB.1.raw
  modified_base (252)..(252): a, c, t, g, unknown or other
  misc_feature (252)..(252): n is a, c, g, or t
  modified_base (339)..(339): a, c, t, g, unknown or other
  misc_feature (339)..(339): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggaggcgtggtccggcctggggggtccctgagactctcctgtgccatgtctgcgtctgaattcatcctcaggtcactatggcatgcactgggtccgcaggccccaggccaagggactggagtgggtgcatttanacatttgatggagaattaaaaatttacgcagactccgtagaagggcctattcaaccatctaccaagacgaccttccaacctataacnctagtactctaccaaatgtaacagtggtacacgtagttagaacgtacgacggtactaaactttagttaatttgtaggaacgtaaaaggtactttccggtttagggtttacgagtctactacgtaagtggtagggtaagtacggggtcggtaccgtccgtaccgtacccgtcgggggtacctaacggggtaacctacggttcgggttaccctacccggtcttacccgttaccgaacgttccccgacccgtaaacccggtaccggggtaaccccctacggttaccccgggtttccccgttacccccccggttagggtaccccctaccccccgtttacccgtaaccccgaaacgggtacccgtacccgttaacccccgg

SEQ ID NO: 44053 - DNA, 785 bp, Homo sapiens
  misc_feature: GYAE6OF02JQYPR.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgtaattcatcctnaggcactatggcatgcacgtgggtcccnccacggccccaggcctaaagggctgggagtggggtagctaagtttanactaagtttgagtggaagtaataaaaaaacgtttttcgacgaacggtaccttccggtaggtaacgggaccggtaagttaccaccattaccgtccgaagtaccggtaacccctttaccaaaccctattaccgtcttaggttaacctacttaacctaaacgtacgtaaaccgtattagggtacgtaacctaggttacgaaacggtaaccgtaacgacgttaaacttatttagtacgtaggtacgtaaagtacggtttcgttaggttcgaagtcgtacttacgagttacggtagtaggtagggttcgaccgtacgtacgacccggtagggtacccgaaagggtaccctaccggttagggtcccgtaaccgttcccgttaccggtacctaaccgttccccgacccgtaacggtaccgggtaacccccttggttaccccgggttttaccccgccccccggtttaggttaccccctacccccgttacccgtaacccggaaccggttccggtaaccccgttaaccccggg

SEQ ID NO: 44054 - DNA, 696 bp, Homo sapiens
  misc_feature: GYAE6OF02FHJ5S.31.14.B03.1.454.CMB.1.raw
  modified_base (323)..(323): a, c, t, g, unknown or other
  misc_feature (323)..(323): n is a, c, g, or t
  modified_base (392)..(392): a, c, t, g, unknown or other
  misc_feature (392)..(392): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctggagactctcctgtgccatgtctgcgtctggaattcatcctcaggcactatggcatgcacgtgggtccgcaggccccaggcgaagggctggagtgggtgactatttatactaatttcgagtggaagaattaaaaactttcgactacgacgtaccgtggaacgggcctatttccacntcctaccgaggacgtccccttacaacacgtacgcttggtactcgtaccaaatcggaactagtcgggtanacgtagttacgaacgacgaacggtactaacgtttatttgtcgtcgaacgtaaagtctttcggtggttacgacgacttatccgaagttggtaggtacgtggggttacgacttacgggaaccgtacgggtcggggtaccgtaagggaacctaccgggttcggttaccgaccgtttcctcccgtacggtacccgtaccccggtaccgtaacccggacgggtaccccttacggtaccccggtttcccttcccccggaggtaccccttaccccgtccgttaaccggaacggttccgtacccctaccggg

SEQ ID NO: 44055 - DNA, 600 bp, Homo sapiens
  misc_feature: GYAE6OF02JC6VN.31.14.B03.1.454.CMB.1.raw
  modified_base (213)..(213): a, c, t, g, unknown or other
  misc_feature (213)..(213): n is a, c, g, or t
  modified_base (588)..(588): a, c, t, g, unknown or other
  misc_feature (588)..(588): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatgcatgcactgggtccnccaggccccaggcctaagggactgggagtgggtggcatttatacaatttgatggagaattaaaaattttacgcagactccgtagaaggccgattcaccatctccagacgacccttccaaccataccgtctgtatctccaaatgaacatggtagactaggttagaagacacggataacttattagttacgtgacgaaatagtttcgttggttcgagtcatacaatgtaggattagggtagctacgacaccgtgggaccgagggaacacgtcggtactaccggtcctcccgttcacgtccctaccaacccgacgggtcccctaagttcccggtccctttcccccgcggcccctacccttcccgtaacccaaggaccncccgtaacccgg

SEQ ID NO: 44056 - DNA, 884 bp, Homo sapiens
  misc_feature: GYAE6OF02GEBMW.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactatggcatgcacgtgggtccnccacggccccaggcaagggctgggagtggggtcgctaagtttanaactaatttgatgggaataaattaaaaaattttcgacaaggtaccttcccggtaggaaacggggtcccgtaatttaccgaaccctaagttccctaaccgaagtaacccggtaaccccctttaacccaaaccctaacgttacccggaccttacggttaaccttaccctaaccctaaaagtacggtaaacctaagtttggggttaacgtaaactaagggtttaacgaaacggaaccgtaacggggtaccttaaaccttttaattttagtttacggtacggtaacggtaaaagttacgttttcgggtttacgggtttaaccggagtactaacgttacgtaaggttaggtagggtaacggtttacgggggtacgtaccgttaccgggaaaccgtacccggggttacgggggaacccgaaaggggtaacctaccggtttacgggtaccccggttacccgtttcccgtaccccgttacgaaccccgtcccgttaccccgaaccccggtaacgggtacccccgttacgggtttcccccgggtttacccccgtttccccccggtacgggtaacccccctccccgtttaccccggtaaccccgaacgggtacccgtcccccgttaaccccgggg

SEQ ID NO: 44057 - DNA, 1000 bp, Homo sapiens
  misc_feature: GYAE6OF02I9GMB.31.14.B03.1.454.CMB.1.raw
tcagcagtagacgtcacgaccggtgctcgatttagtgtgagtagtttgggcgtgagctgggttttcctcgttgctctttaagaggtgtcagtgtcaggtgcacctggtggaatctgggggaggcgtggtccggcctggggggtccctgagactctcctgtgccatgtctgacgtctagaattcactcctcaggcactatggctatgcacgtcgggtccaccacgggcccctaggcctaaaggggccgtaggggacggttggggtcggtactaattttactaacgtaagttttagagttagggtaaagtaaactttaaaaaaagttttacgaaccgtaaggtaaccttaccggttaacgggaaacggggccccgttaaagttaccccggtaaaccccaagtttaccccgttaacccgtaacgggtaaccggttaaccccccccttaacctaaaaaccccggtaaccgttaaaaccccgggtcccgtttagggtttaaacccgttaccctaaacccgttaaaaacgttaaccggaaaaccgtaacggttttaagggaaccggttaaaccgttaaacgggtttacggaaaacgggttaaacccgaaaccggggtaaaccttaaacccgttttaaagtttttaacgtacgggttacggtaaacccggttaaaaaggtaccgggttttaacggttttacggggttacgttaacggtaacgtaacgttaaccgtaaaggttacggttaagggttaacgggttaggggttacgggtaccgttaaccggtaaccgtaaccgggttcgggggtaaaccgttaacggggaaaccgttaaccggttacggttacccggtaaccgttacccgttacccgtaacgtaacccgttccccacccgtaacccggaaccgggtaccccgtaaccgttcccgggttaccctttaccccccggtaggaccccgttaccccgtacccgtaccggtaacccggtactacccgtaaccccgg

SEQ ID NO: 44058 - DNA, 781 bp, Homo sapiens
  misc_feature: GYAE6OF02GMNC8.31.14.B03.1.454.CMB.1.raw
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctgggggtccctgagactctcctgtgccatgtctgcgtctgaattcatcctcaggcactatggcatgccagtgggtcccaccacggccccaggcaagggactgggagtgggtgctatttanactaattgatggaagtaactaaaaaattttacgacaagtacctccgtgaagggccgtattacaccgatcctccagacgacccttaccaaccatacgctagtactctaccaaagtcgaaactagtgggtacgaaccgtagttacggaacgaactaacggactaaactttagttaacgtttgtagaaccgtaaaagacttttcgggttacggtttacgacggtacctaaattaccgtaaagttaggtttagggaacgttaaagggggttcgggacctttaccgggaaccgtaccccgggttaacggggggaccctaaacgggggtaaaccgtaacccggttgggttaaccccgtaaccggttcccgttaccccgttaccgaacccggttacccctaacccgaaccccggtaaaacccggggtcccctaaaccggtttccccggggtttacccccttaccccccggtttaggacccccgttaacccctaccccgttaacccgaaacggttacccgacccgtaaccccggg

SEQ ID NO: 44059 - DNA, 732 bp, Homo sapiens
  misc_feature: GYAE6OF02HKJT9.31.14.B03.1.454.CMB.1.raw
  modified_base (174)..(174): a, c, t, g, unknown or other
  misc_feature (174)..(174): n is a, c, g, or t
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (382)..(382): a, c, t, g, unknown or other
  misc_feature (382)..(382): n is a, c, g, or t
  modified_base (462)..(462): a, c, t, g, unknown or other
  misc_feature (462)..(462): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtntgaattcatcctcaggcactatggcatgcacgtgggtccnccacggccccaggcaagggactggacgtgggtcgntagtttanactatttgatggaagtaattaaaaattttacgcagactaccggtagaagggccgtattacgacctatctccgagtacgacccttaccaactactacgctagtatctaccgtaaatgaacagtggngtaatagttaggaaagacgacggtactaatttacgttaattcgtggaacgtaaagtacgtttacgtttacggtacgtaancgtaagtactaaagttcggtaggttaagtaggggtacgtccgttacgaaccgtaccgggttcggggaccgtaaacggggtaacctaacggtttcgggtacccgtaaccgtcccgttaccgttaccgacgtaccccgtaccccgaacccggtaacccggggtacccgtaaccgtttacccgggttccccctttaccccccggtacggggttacccccttacccccggtacccgttaaccccggaaacggttccccgacccttaaccccggg

SEQ ID NO: 44060 - DNA, 743 bp, Homo sapiens
  misc_feature: GYAE6OF02I4DR7.31.14.B03.1.454.CMB.1.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagcagtagacgtcacgaccggtgctcgatttagtgtgagtagtttgggctgagcgtgggttttcgtcgttagctcttttaagaggtgtccagtgtcaggtgcacctggtggaatcgtgggggaggcgtggtccggcctggggggtccctgagactctcctgtgccatgtctgcgtctgaattcactcctcagcactagtgcatgcacgtggtccgcacggcccaggcaagggctggnggtgggngctagtttaanactaatttgattgggataaattaaaaaacgttttacgacgtaacgaccgttccggtaaggaacggggcccttataccacctactccgtaccacgacctaccccttaccaaccgtactaaccgcgttagtacttccgtacctaaatacgaaactagtcggtagtaacgagttagaaacgtacgaacggtacctaaactttagttacgttagttagaacgtaaagttcgtttacggttagtttcggaagtctaatacgtagtaggtggaagttcgggtcgtcttacgaccgtacgggtcgggacccgaagggtacccgtacggttacggtacccgtacccggttccttacccgacgtaaccctcccgtacccgaaacccggtacggggtaccccacgttttccccggttccccgttaccccccggttggttaccccccgtaaccccgttcccgttaaaccccggaacgggtctaccccggttcccggg

SEQ ID NO: 44061 - DNA, 848 bp, Homo sapiens
  misc_feature: GYAE6OF02GUFES.31.14.B03.1.454.CMB.1.raw
  modified_base (189)..(189): a, c, t, g, unknown or other
  misc_feature (189)..(189): n is a, c, g, or t
tcagcagtagacgtcacgaccggtgctcgatttagtgtgagtagtttgggcggtgagctgggttttcctcgttgctctttaagaggtgtccagtgtcaggtgcacctggtggaatctgggggaggcgtggtccggcctggggggtccctgagactctcctgtgccatgtctgcgtctgaattcatcctnaggcactatggctatgctacgtcgggtcccgccacggccccagggcaagggactgggaggtggggtgctatttaactactaagtttagagttaggaagtaaattaaaaaacgttttacgacaagtaccgtccggtaggaacggggtccgtaacgttaccaacccgtattccgtaccgaggacccgtaaccccttacccaacctaacgttaccgccttacgtacttaccacctaaaatacgaatacgtggtacgacgtaaggttagaacggtaacgaaccggtaacttaaacgtttagttttacgttacggtacggtaaacggtaaaggttacttttacgggttttacggggttaacggtaacgttccgtaaagttaccgtaaaggttgggttacgggtaaggtttacggggttcgggccctttaacgggacccgtaccggggttaaccgggggaccggaaacgggtaacccggttaaggttcggtacccgtaaccccgggtttcctaccccgtacgaaccccgttcccgtacccgaaccgtaaccccggggtccttaccgggttacccccggtttccccgttacccccgtcccgggttacccccgtacccccgtttacccggtaaccccgtaacggtcccggtacccgtaacccccggg

SEQ ID NO: 44062 - DNA, 732 bp, Homo sapiens
  misc_feature: GYAE6OF02JY4FC.31.14.B03.1.454.CMB.1.raw
  modified_base (252)..(252): a, c, t, g, unknown or other
  misc_feature (252)..(252): n is a, c, g, or t
  modified_base (700)..(700): a, c, t, g, unknown or other
  misc_feature (700)..(700): n is a, c, g, or t
tcagcagtagacgtcacgaccggtgctcgatttagtgtgagtagtttgggcgtgagctggtttcctcgttgctctttaagaggtgtccagtgtcaggtgcacctggtggaatcgtgggggagcgtggtccggcctgggggtccctgagctctcctgtgccatgtctgcgtctgaattcatcctgaggcacctagtggcagtcgctacgtgggtcccgccaggccccaggtcaagggtactcgggagttgggngctatttacgactaagtttgaagtggagtaactaaaaagttttcgactacgtacgtaccggtaggtaacgggtacccgttagttaccctaacctactaccgtaaccgtaaggtaaccgtaaccccctttaaccgaaacccgtacgtaaccggtccttaagtaccgtaccttaccgaaacttacggaactagtcggtcgtaacgtacggtagtaacgactaccggtactaacgtttactagtgtacgaacgtactaggttcgttaagggtcgtaagtacaagttacgtaagtaggtcgtaggtacgtcggtacgtcgacgtaccgtacgggtaccgaaggtaccgtacggttcgtaacgtcccgttcgtaacccgtcgtacccgtacctcccggtaactaccggggtccccttaacggtcccggttacccgtttccccgaggttccccnccggtaccctacgtaactcggaccctacccgg

SEQ ID NO: 44063 - DNA, 922 bp, Homo sapiens
  misc_feature: GYAE6OF02H96TH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtgggggtccctgagctctcctgtgccatgtctgcgtctgaattcatcctcaggcactagtggctagtcgacgtaccggtcggggtcccgccgacgggcccccgaagggacgaagggacgtgggagggttcggggtggaccttaattttaactaacgttaattttggaagttaggaagttaaaattaaaaaacgttttccgacgaacggtaccgtaccggtaggtaacgggaccgtaattcccaaccgtactccgtacacggtaacctaccccttaccaacctacgtacgctagtactacctaacgtaaatacgaactagtaggacgtacgtagttagaacgtacgtaacgtaacttaacgtttaagttagtttacggtacggtaacggttaaacggtttacggttttacgggttttacgggttaaccggtaacgttaactaccgttaaacggtaggttaaggggttacgggtaaacgggtttacggggtacggttaccgttaacccggggtaaaccggtaccggggttaccgggggtaaaccggtaaccggggtaaccctacggggttacccgggtaacccgtttaacccgggtcccctaaccgtacccggtaaccgttacccccgtacccgggtaaaccccggtacccggggtaaccccgttacccggtttaccccggggttcccccccttttaccccccgggaccgggttaccccccttaacccccggtaccccggtttaaacccggaaccggttacccggtaccccggttaaccccgggg

SEQ ID NO: 44064 - DNA, 694 bp, Homo sapiens
  misc_feature: GYAE6OF02FP68X.31.14.B03.1.454.CMB.1.raw
  modified_base (163)..(163): a, c, t, g, unknown or other
  misc_feature (163)..(163): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (652)..(652): a, c, t, g, unknown or other
  misc_feature (652)..(652): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtnccatgtctgcgtctgaattcatcctcaggcactagtggcatgcacgtcgggtacccgccgacggccccagggacgaagggactgggaggtggggtgtactatttatactaagttttgagtaggaagtaaattaaaaatttcgcagactccggaggacggctatcacntcncagactacctcaacatacgcttagtactctaaccaaatcgtaactagtcggtacgtaacgtaggttacgaaacgaccgtaacggtacttaaacgtttagttaaggtttcggtagtacggtaaaagttcggttttagggttacggttaacggtacgtactagtaacgtaagttggtagggttaagtcgggtacgtcgtacgtacgaccgggtacggaccgaagggtaccacggtcggtacctaccggttacctccgtacgaccgtcccgtacccgtaccggaaccgggtcccttacggtaccccgttcccttaccccggngtacccctacccgtacctacccggagtacccgtcctacccgg

SEQ ID NO: 44065 - DNA, 734 bp, Homo sapiens
  misc_feature: GYAE6OF02FW3T3.31.14.B03.1.454.CMB.1.raw
tcagcagtagacgtcacgaccggtgctcgatttagtgtgagtagtttgggcgtgagctgggttttcctcgttgcctcttttaagaggtgtccagtgtcaggtgcacctggtggaatcgtggggagccgtggtccggccgtgggggtccctgagtactcgtcctgtgcctatgtctgtcgtctagtaattcatcctcgaggcactatggtcatcgacgtacgtcgggtccccgacgaccggcccccgaggaccgaagggaccgtgggaggtgggtcgtctaagtttagtaactaagtttgagtaggtaagtaaaacttaaaaaacgtttcgacgtaagtaccgttacggtaggaacgggtcccgtacgttacgaccgtactccgtaccgaacgaccgtaaccccgttaccaacctacgtacgcgttacgtactcctaccgaaagtacgtaaacgtgtaggtacgaacgtaaggtaacgaaggtaaccaacggtacttaaactttaagttacgttcgtaaggtaaccgtaaagttcggtttggtttaccggtacgtacgactacgttacagttggtagtaggtcggtgacctcgactccgggtggacgaacggtacaccgttcggtacctaccggtcctacgtccgaccgtccgtacccgacgaccggtccttaaccggtcccgtcccgtccccgtacgtccccttacccgtccaccgaacgtacctccgtaccgg

SEQ ID NO: 44066 - DNA, 737 bp, Homo sapiens
  misc_feature: GYAE6OF02I17J1.31.14.B03.1.454.CMB.1.raw
  modified_base (405)..(405): a, c, t, g, unknown or other
  misc_feature (405)..(405): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggctgggggtccctgagactctcctgtgccatgtctgcgtctgaattcatcctcgaggcactagtggacatgcacgtcgggtcccaccgacggtcccccagggtccaaggggacctgggacgtggggtacgctatttactactaagtttgagtggaagtaaattaaaaatttacgacagtacctcggtaggaacggggacctataccacctagttacctccaggtaacgtaccccttaccaaccagtacctcttagtacctacctaacctaaanagtaactagtacggtacgatacggttagaaacgaccgtaccggactaactttaatagttacggtagtaaccgaaagtttagttccggttaggttacgacgtactaagttaccgaagtggttacgggtaagttacggggtacccgtgtacccggaaacgtccgggtacggggaaccggtaacgggaactaccgggttcgtaacccgtaccgttcctacccgtcgaacctccccgtaccgaaccggtacgggccctaccggttcccgttaccccgttccccggtaccggccccttaacccgttccccaaccgtaccgaacgtcccctaaccggg

SEQ ID NO: 44067 - DNA, 749 bp, Homo sapiens
  misc_feature: GYAE6OF02HSP6Q.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctnaggcatagtggcatcgcacgtggccgcgaggcccaggcgaagggacgtggaggtgggtcgactagttactactaagtttgagtaggaagtaaattaaaaaatttacgactagaccgtcggtaggaacggtaccgtaattacgacctagtacctacgaacgtaaccgtaccccttaccaaactaagtaccgtacgttacgtaacttacgtaaccaaagtacgaaacgtatacgggtacaacgttaaggttaacggaaacgtaccgaacggtaactaaacgttttatttaacgttgggtacgaaacggtaaaggttacttttacgggtttcggttaacgacgtaactacgtactaaaggttcggtaggtaaggttacggggtacgtaccgtacggaccgtacggtcgggggaactaacgggaaccgtagtcggtacctaccgttctccgagtaccgtccctacgtaaccggaacggtccctaacggttccccggttacccttcccccgggtagtacccgttacccgtacccgtaaccgaaacggtccgaccctaaccgggg

SEQ ID NO: 44068 - DNA, 772 bp, Homo sapiens
  misc_feature: GYAE6OF02FZ2LI.31.14.B03.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactatggcatgactacgtcgggtcccgccacgggccccaggcgaaagggctgggnggtgggngctatttanaactagtttgatggaagaaattaaaaaacgttttacgacaagtaaccgtccggtaggaacgggccgtacgttaccaacctactacctaccgaagaaccgtaccccttaccgaacccataccgctgttactaccttacaaagtagaactagtaggtcgaacttaaggtagaacgaaccgacgactaaacgtttattagtcgtagtaacgtaaaacgttgttttcgggttacgtttacggactacgtaacttacaaacgttggtaacggttaaggttacgggtacggtcccttacggaccgtttaccgggacggggttacccgaaacgggtacccgttacgttacggggtacccttaccggtccttacccgtacgacgtacccccgtacgaaacccggtacccgggcccgttaacggttcccggtttaccccccgtttacccccggtcggtacccccgtacccccgttaccgtaacccgtaaacggcccgttacccccgttaacccgggg

SEQ ID NO: 44069 - DNA, 821 bp, Homo sapiens
  misc_feature: GYAE6OF02HFIJ6.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtgccatgtctgcgtctgtaattcatcctcaggcactagtggcatgcacgtcggggtcccgccaacggccccaggtacgaaacggggactggggaaggttggggtcggcttaattttaactaaccgtaaagttttggaagtagggtaacgtaaaattaaaaaaagtttttaccggacgtaacgaacttcccgggtaggaaacggggtaccgtaacttaccaacctatcctaccgaagaccgtaaccccttacccaaaccgtataccgcgttagtactacctaacctaaagtacgaaactagttaggtaacaacgtaggttacggaaacgtaccgtaacggtacttaaactttagtttagtttacgtacggaaacgtaaagtacggttttcggtttagggttaccgtaagaccgaattaccgaaagttgggttagggaagttacggggtgcccgttaacggaccgttaccgggttcggggaacccgaaggggtaaacctaccggttcggttacccgaccgtttacccgtaccgtaccgaccgttccccctaacccgaaccggtaaccgggaacccttaccggttcccgttccccgtttacccccgtggaccccctaccccgttacccgtaacccgaaacggttcccggaccgttaaccccgg

SEQ ID NO: 44070 - DNA, 918 bp, Homo sapiens
  misc_feature: GYAE6OF02H7Q72.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtgggggtccctgagactctcctgtgccatgtctgcgtctagattcatcctcaggactactagtggctatcgcacgtcgggtccaccgacggccccaggacgaagggcgtagggacggtgggtggactatttacaacgttaagtttcgaagttaggaagttaaaagtttaaaaaaacgttttccgacgtaacgtaaccgttaccggttacggaacggggtacccgttaacttacccctaaccgtacgtttaccccgtaaccgtaaccggtaacccgttaaccccctttaaccccgaaaaccccggttaacttaaaccccggtcgtttaacggtttaacctacccgttaaaccgtaaaccgttaccgtaaacccgttacgtttagggtaaccgaaccgttaagggtttaacggaaaacccggacgtaaccgggtaactttaactttaagtttacgtttacggtacgaacggttaaagtacggtttttcggtttaccgggtttacgagtacgtacgtagtaacggttcgggttaaggtaacgggttacgggtaacggttccgtaacccggtaccggtaacccgggttggggaaacccgaaagggtaaccgtacccgggttaccggtacccgtacccgttaccgtcccgtaaaccgttccggtacccccgtaccgaccccggtaaacggtcccgttaaccggttccccggttaccccgtttccccgaccggttaccccgtaacccccgtccgttacccgtaaccgtacccggtacccgtacccggg

SEQ ID NO: 44071 - DNA, 792 bp, Homo sapiens
  misc_feature: GYAE6OF02GGN70.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtgggggtccctgagactctcctgtgccatgtctgcgtctgaattcatcctgaggcactagtggcatcgcacgtgggtcccgaccacgggccccaggacgaaagggtccttgggaggttgggtcggactagttttaataactaatttgaagttaggaataaagttaaaaaacgtttacgacgaacgtaccgtacggtaggaacgggtaccgtaacttacacctaactccgtaccgaacgaccgtaccccttacccaacctaacgtacgtccttagttactacctaacctaaagtacgaaactacgtacggtagtaaccgtaggttaacgaaacggtaacgaaccggttaacttaaacgtttactttagttacggtacgtaacgtaaagttacggtttcggtttacgggtacgtaacgtactacttaacgtaaggttaggtaagggttagtagggggttcgtaccctacggtaacccgtccgggtacgggaccggaacggtaccgtacggtaccggtaccgtaacccgttccctccgtaaccgaccgtacccctaccgacccgtaacccggtccgtaaccggttccccgttaccccgttcccgtaccgtaccccgtaccccgttacccgtaaccggacgtaccgtacccgtcccggg

SEQ ID NO: 44072 - DNA, 786 bp, Homo sapiens
  misc_feature: GYAE6OF02JFHMB.31.14.B03.1.454.CMB.1.raw
  modified_base (213)..(213): a, c, t, g, unknown or other
  misc_feature (213)..(213): n is a, c, g, or t
  modified_base (401)..(401): a, c, t, g, unknown or other
  misc_feature (401)..(401): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcactcgggtccncgacggccccaggcaagggctggacgtgggtgctattatacgatttgacgtggagtaattaaaaaagtttcgacgtagaccttcggtagaacggggcctagttaccacctattcctaccgaagtaaccgtaccccttaccaacccgacgttaccgactacgtacttaccgtacgtaaaactgaaaccngttacgggtacgaacgtaggttacggaagaacgtaccggacttaaacgtttaagttagtttcggtagaaccggtaaaagttcgtttaccgggtttagggttacgtaccgtacgtaacttaccgaaagttcggtaagggttaggttaacggggttcggacttacccggtaccgtaaccgggttcggggaaaccgtaaccggggttaaccgaccgttttacggtaacccgtaacccgtttcccgtacccgtacggacccgtaaccccttaccggaaacccggttacgggaaccccctaagtttaccccgggtcccgtttaccccccggttagtaccccccgtacccgttaccccgtacccgtaacggaaccgttcccctaacccggg

SEQ ID NO: 44073 - DNA, 757 bp, Homo sapiens
  misc_feature: GYAE6OF02JSII4.31.14.B03.1.454.CMB.1.raw
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctgggggtccctgagactctcctgtgccatgtctgcgtctgaattcatcctnagcactatggcatcgcacgtgggtccacacggccccagggacgaaggcnggagtgggtgctatttacgactaagttgaagtggaagtaaattaaaaacgtttcgacagtaccgttcggtagaacgggccgtaattaccgactattcctaaccgacgtaccgacccctttaccaaccgtaattaccggntactacgttacctaacaaaacgttcgaaacgtacgtttgacgtaaccgtagttaaggaaacgtaccgtaacggtaacttaaacgtttagttaacgtttagtacggtaacgtaaacggtttagttaccggttttacggttacgaagtccaagttaacaaggttggtaaggtacggttaggggtacgtaccgttaccggaaccgtaccgggtcggggaaccgtaacgggtaacgtaaccgttcgggtaccgttacccgttaccgtcccgtaaccgaaccgtcccaccggtaaccgtacgggtacccccgtagttcccgggttccccttaccccggtacgacccccgttaccgaccccgttaacacggtaccgacctaccccggg

SEQ ID NO: 44074 - DNA, 588 bp, Homo sapiens
  misc_feature: GYAE6OF02F28JP.31.14.B03.1.454.CMB.1.raw
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccagggcaagggactgggagtgggtggcatttatacaatttgataggaagaattaaaaaattttacgacagactccgtaggaagggccgattcaccatctccagacgacccttaccaaccactacgctgtatctacaaatgaaacatggtagacgagttagaacgacacggactaactttattattgtgacgaaagtntttcgttggttcgagctatcagtgtggagtgggtcgctcgaccacggtcgggacagggacacgtcggtcaccgtctccgtacacgccctaccgaccgacgggccccacgttcccggttacccttccccgtagcccctacccgtccctaccgaacgtccgactacccg

SEQ ID NO: 44075 - DNA, 817 bp, Homo sapiens
  misc_feature: GYAE6OF02GKTA1.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccgacggccccaggcgaagggtactgggaggtgggtgactagtttactactaagtttgagttaggaagtaaatttaaaaaagttttcgactaagtaccgttccgtaggaacgggtccgtaattcccaacctacgttcctacccgaaggtaacccgtaaccccctttacccaaaccgtacgttacccgcttacgttaccttacctaaccgtaaaacgtggaaacctaggtttacgggacgtaacgttacggttaacggaaacgtaacccgaccggtaaccgtttaaaccttttaagtttaacgtttagggtaacgtaacggtaaaagttcgttttacgggtttacggttccgaagtacttaagtacgtaaaggtttcgggaggttaacgggtacgggttacgacccgttacgggaaccttaaccgggtcgggggaaacccttaacggggaaaccttccggttacgggtaccccttaccgttaccgttccgtaaccaaccggtcccctacccgaaccggaaccgggtccctaaccggttcccggttaccccgttcccgtcgacccctacccgttaccgaaccctaagggaccctccgtacccgg

SEQ ID NO: 44076 - DNA, 846 bp, Homo sapiens
  misc_feature: GYAE6OF02IGALL.31.14.B03.1.454.CMB.1.raw
  modified_base (186)..(186): a, c, t, g, unknown or other
  misc_feature (186)..(186): n is a, c, g, or t
  modified_base (249)..(249): a, c, t, g, unknown or other
  misc_feature (249)..(249): n is a, c, g, or t
  modified_base (746)..(746): a, c, t, g, unknown or other
  misc_feature (746)..(746): n is a, c, g, or t
tcagcagtagacgtcacgaccggtgctcgatttagtgtgagtagtttgggctgagctggttttcctcgttgctcttttaagagtgtccagtgtcaggtgcacctggtggaatcgtgggggaggcgtggtccggccgtgggggtccctgagactctcctgtgccatgtctgcgtctgattcatcctnaggctactatggctatgcctacgtcgggtcccgccgacggccccaggcgaagggacgtacggnggtcgggtagactagtttatacgttaagtttgagtaggtaacgtaaagtttaaaaaacgtttaccgacgtaacggtaacccgttaccggtaacgggtaacggggtacccgttaacgtttaccccgtaaccgtaccgttacccctaccgtaaccgggaacccgttacccccttaacccaaacccgttaagtaacccggtacttacgttaacgttacccttaaccgtaaaagtaaccgtaaaccgtaggttttacggtaacgaaacgtttaaggttaacgtaaaacggaaaccgaccggttaacttaaaccgtttaattttaacggtttaccgtaggtaacgtaaaggtttacgtttacgggtttaggttaccgaaggtacgtaattaacgttaaaggtggtaaggttaaggttcggggttacgtaccgaacgtaccgtaccgggacggggtaccgaacggtaccgacgtacgggttacctcccgggtactcccgtacncccgtaccgtacccaaccgacccggacccttcgtcccggttaccccgttcccgaacccggtccctaaccccgtccgaacaccggtaccgtacccgtccgg

SEQ ID NO: 44077 - DNA, 926 bp, Homo sapiens
  misc_feature: GYAE6OF02JOKD9.31.14.B03.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctggggggtccctgagacctctcctgtgccatgtctgcgtctgaattcatcctcaggcactgtggctatgctacgtcgggtccnccgacggccccagggccgaaagggcgtgggtaggtcgggtggctaattttacgtaactaagtttgaagttacgggaaagttaaaatttaaaaaacgttttaccgacgtaaggtacccgttccggtaaggaacggggtcccgttaatttacccaaccgtacttaccgacccgtaacggtaacccggtacccccttaacccaaacccgtacttaacccggtcttacggttaacgtttacctaaccccgtaaaatacggtaaaccgtaacgttcgggtacgtaaccgttaagggttaacggaaacggtaaccgtaaccggtaaccttaaacgttttaagttttagtttacgggtaacgtaaacggttaaagtttacggttttacgggttttcgggttaacgacgttaccgtaaggttaacttaacggttgggttaacggttaaggttaccggggttcggtaacccgttaccggtaaccggtaccgggttaccgggaaccgtaaccgggtaacctaccggttccggttacccgtaccgttaccgttacccgtacgtaccccggttacccttaacccggaacccggttaacccgggtccccgttaaccggtttccccgggtttacccccccttaccccggttaccgacccccgttaaccccgttacccgtacccggtaaaaccgtcccccggttaaccgttaaccccggg

SEQ ID NO: 44078 - DNA, 800 bp, Homo sapiens
  misc_feature: GYAE6OF02I6LX1.31.14.B03.1.454.CMB.1.raw
  modified_base (165)..(165): a, c, t, g, unknown or other
  misc_feature (165)..(165): n is a, c, g, or t
tcagcagtagacgtcacgaccggtgctcgatttagtgtgagtagtttgggctgagctgggtttttcctcgtttgctcttttaagaggtgtccagtgtcaggtgcaccgtggtggaatcgtgggggaggcgtggtccggccgtgggggtccctgagactctcctgngcatgtctgcgtctgtattcactcctcaggcactagtggcatgcacgtcgggccaccgacggcccaggacgaaggacgtggaggtgggtgctattacactagttgagtaggtaataaatttaaaaactttcgacgaagtaccgtacggtaaggacgggacctacgtaccaccgtactccgtacgacgtaccgtacccctaccaaccactaccgtactagtacttacctaacgaaacgttacaacgtaggtaggtacgtaacggtaacggttaagaaccgaaccggtaaccgtaacttaaaacgttttaatttaagtttaggtacggtaaacgtaaaggtttacgtttttacgggttacgggtaaccgtactaaaccgtagttaaaccgtaagttagggtaacgggttaaggtttagggggtaccgttaccggtaaccgggtaacccgtaccggggtaacggggaacccggtaacgggaacgtaccggttacggtacccgtaacccgttaccgtaccctacccgaaccgtccccgtacccgacccggtaaccggccccttacggttaccccggttcccctttcccggtacccgtacccacccctttacccaacccggaccgaccgtacccaccggg

SEQ ID NO: 44079 - DNA, 867 bp, Homo sapiens
  misc_feature: GYAE6OF02I4R6G.31.14.B03.1.454.CMB.1.raw
tcagcagtagacgtcacgaccggtgctcgatttagtgtgagtagtttgggctgagctgggtttcctcgttgctctttaagaggtgtccagtgtcaggtgcacctggtggaatctgggggaggcgtggtccggccgtggggggtccctgagactctcctgtgccatgtctgcgtctgaattcatcctcaggtcactagtggcatgccacgtcgggtcccgccgacgggccccagggcaaggggacctgggaggtgggtggactattagtacaagtttgagtcggtaagtaaacttaaaaaacgttttcgaccaagtacccgttaccggtacggaaacgggggccctaagtttaccaacccgtaacgttccctaccgaacggtaaccgtacccccctttaccaacctaacgtaccgtacttacggtactaccctaaccgtaaaatcggtaaacgtacgttacgggtacgtaaccgtacgtttacggaaacgtacgaaccgggtaacctaaaccgtttaggtttaactttacggtacgtaaaccggtaaagttaacgtttccggtttacgggttacgtaacggtcgtaaacttaccgtaagttacggttacgggtaacggttagggttaccgggaccttaccggaacccgtaccgggtaccggggtacccggaacggggttaaccctaccggttaccgggtacccttaaccgggttcccttaacccgtccgtaaccggtcccctacccggacccgtaacccgggtcccccgtaaggttaccccgggttaccccttacccccggtagggtaccccccctaccccggtttaacccgtacccggtaaacggtacccgtaccccgtaaccccgg

SEQ ID NO: 44080 - DNA, 831 bp, Homo sapiens
  misc_feature: GYAE6OF02JPXN5.31.14.B03.1.454.CMB.1.raw
  modified_base (715)..(715): a, c, t, g, unknown or other
  misc_feature (715)..(715): n is a, c, g, or t
  modified_base (725)..(725): a, c, t, g, unknown or other
  misc_feature (725)..(725): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgattcatcctcgaggcactatggcactgctacgtcgggcccgaccgacggcccccagggcgaaacggggtacgtggggaggtcgggggtgtcttatttactaacttaaaggtttgagttagggaataaaaatttaaaaaaacttttccgacgtaagtaccgtttacccggagggtaaaccgggggcccgtaactttacaaaccctttacccgttaccgacggttaaccgtaaccccttttaacccaacctaagtaccgtcctacggttaacttacccaaaccgtaaaatcggtaaaccttaggttacgggtacgtaaaccgtttagggtaaacggtaaccggacgaacccgggttaacttaaacttttaaaggtttcgtttggaacgggtaagtaaaaccgttaggtttttacgggtttcgggttaaaccgagtaccgtagttaacgtaaacgttggaacggtaaggtcggggttcggcttaccgggacctacgggtacggggacgtaacgggactaggtcgtacccgtaccgttccncgtacctacncccgtaccgacccgggtaacggcccgtacggttacccggtccccgtttcccggaccgtaccccgtacccgttcttaaccccgaacggtacccgtcgtaaccccggg

SEQ ID NO: 44081 - DNA, 706 bp, Homo sapiens
  misc_feature: GYAE6OF02HE4ZP.31.14.B03.1.454.CMB.1.raw
  modified_base (480)..(480): a, c, t, g, unknown or other
  misc_feature (480)..(480): n is a, c, g, or t
  modified_base (548)..(548): a, c, t, g, unknown or other
  misc_feature (548)..(548): n is a, c, g, or t
tcagcagtagacgtcacgaccggtgctcgatttagtgtgagtagtttgggctggagctgggttttcctcgttgctcttttaagaggtgtccagtgtcaggtgcacctggtggaatctgggggagcgtggtccggccgtgggggtccctgagactctcctgtgccatgtctgcgtctgaacttcatcctcaggtcactagtcggcagtcgccacgtgggtacccgccacggcccctaggccgaagggactgggacgtgggtggctagtttatacgtaattttgacgtaggaaagtaattaaaaaacgttttacgacgtaacgccgttaccggtggaaacggggtccctagtttacccaaccgacttccgtcccaaggtaccgtaccccttaccgaacctatacgctgtactctacaagtacactgtcgtgacgtagtacgaagtacgacgtactaacttagttacgtgtagaacgtaagtntttcggttcgttacgatactatctaagttggtaggttacgttaggggtacgcgtacggacgtacccgnggggtaccctaagggactacgtcggtacctacccgtctacccgtcgtacgtccccacgacccgtaaccggtcccacggtttcccggtacccccgtttccccgtacggtaccccctaccccgtccgtaaccccggtaaccgacccgttaccgtacccgg

SEQ ID NO: 44082 - DNA, 674 bp, Homo sapiens
  misc_feature: GYAE6OF02GQP88.31.14.B03.1.454.CMB.1.raw
  modified_base (219)..(219): a, c, t, g, unknown or other
  misc_feature (219)..(219): n is a, c, g, or t
  modified_base (389)..(389): a, c, t, g, unknown or other
  misc_feature (389)..(389): n is a, c, g, or t
  modified_base (438)..(438): a, c, t, g, unknown or other
  misc_feature (438)..(438): n is a, c, g, or t
tcagcagtagacgtcacgaccggtgctcgatttagtgtgagtagtttgggcgtgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcagtgccacgtcgggtccnccaggccccaggcgaagggactgggagtgggtgctaatttactactaatttgatggagtaataaaaaattttcgacagactccgtgaacggcctagttccaccatcctaccgagacgtaccccgttaccaaccatacgcttagtactcctacaaactgaactagtggtanacgtagtagaacgacgacggactaacttagttacttgagacgtaaagtnttcgttggtcgagactatacgtaagtgtggtaagttagggtacgtctacgacgtacccggtggggtacccaacggggtaacctacgttacgggtacctaaccccgggttcctccgtacgaccgtacccgtacccgtaacccgacggggtacccctacggttacccggttccccgttaccccgtccggtaccccgtacccgtacccttacccggaacggtccgtaccctaccccggg

SEQ ID NO: 44083 - DNA, 746 bp, Homo sapiens
  misc_feature: GYAE6OF02F8B33.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccgccacggccccaggcgaagggactgggaggtgggtgctattatactattgatggaagtaattaaaaagtttcgacaagtaccgtaccgtaggaacgggccgtattccacctatcctaccagacgtacccctacaacctagtcgctagtactacctacaaatacgaactaggtggtacgaactaggttaggaacgaccgacggtaaccttaacgtttagtttatacggtacggaacgtaaaggttcgtttacgggtttacggttacggaacgtaccgtaattacgtaagttcggtaagggtaacgtaggggtcggtcctaccgggaccgtacccgggtacggggaccgtaacggggtaccctacggttcgggtaccctaccggttaccctccgtaccgaccgtacccgtacccgtaacccggaaccggggtcccctaacggttcccccggttcccccgttacccccggtaccggtaccccttaccccccgtacccgttaaccccgtaacggtacccgccccggttaacccggg

SEQ ID NO: 44084 - DNA, 807 bp, Homo sapiens
  misc_feature: GYAE6OF02I76K5.31.14.B03.1.454.CMB.1.raw
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtgggggtccctgagactctcctgtgccatgtctgcgtctgaattcatcctcaggtcactagtcggcagtgctacgtcggggtcccnccgacggcccccagggaccgaagggtaccgtaggaggtgggtgacctagttactactaagtttgagtacggaagtaaacttaaaaacgttcgacacgtaccgttccggtaggaacgggtacccgtacttaccgaccgtaactcctaccgaacggtaaccgtacccccttaacccgaaccgtaactaccggtactcgttaactaccgtaaccgtaaagtaccgaacgtagttgggttacgtacgtaaggttacggaaacgtacccgtacgtaaccttaacgttaacgttttacggttcggtaacgtacggtaaaacgtttcggtttacggtttcgggtacgtacgtacgtaacttacgtagttaggtacggtaagggtcgggttcggtacgtaccggacctaccgggtcgggacccggaaggtacccgtacgttccggtaccgtaccccgttcgtaccccttaacggtacccgtccgaccccgtaacgacccgggtacccttaccggttccggttacccccttcccggtacccgttaccctaccccggtaccgtaacccgtaacgtcccggtacccttacccgggg

SEQ ID NO: 44085 - DNA, 705 bp, Homo sapiens
  misc_feature: GYAE6OF02FM4S0.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaatccatcctcaggcactatggcatgcacgtgggtccncacggcccaggcaagggactgggagtgggtgctatttactacatttgatggagtaattaaaaatttcgcagtactcgtaggaggccgtattcacatctccagacgacctccaacatacgctgtatcctaccaaatacgaacagtaggtagtacgtagttacggaaacgacgtaccggtactaacgtttatttaacgttgtacgacgtaaaggtactttcgggttacgggttacgagtacgtattaacaagttggtagggtaagtacggggttcggtcctacggaacctaccgggtacggggaccgtaacggggtaacctacggttacggtacccgtacgttacccgttaccgtcccgtaccgtccctacccgacccggaaacccggggtcccctaacggtttcccccgggttccctttaccccccggttacggtacccctacccccgttcccgtaaccggtaaccggtacccggtaccgttacccccggg

SEQ ID NO: 44086 - DNA, 619 bp, Homo sapiens
  misc_feature: GYAE6OF02HLXK1.31.14.B03.1.454.CMB.1.raw
  modified_base (496)..(496): a, c, t, g, unknown or other
  misc_feature (496)..(496): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggggaggcgtggtccggccgtggggggtccctgagactctcctgtgccatgtctgcgtctgaattcatcctcaggcactatggcatgcacgtcgggtccgccgacggccccgacgggacgaagggaccccccgtgggaggtggggtgggacgtagtttaataactaattttgatggaagtaattaaaaaatttttaacgacaagactaccgtaggaagggaccgattacaccatctccagacgaccttaccaaccatacgctgtatctaccaatacgaacatggtgacagtagaagacacggacaacttattattgtgacgaaagtatttcggttaggtacgagcatcaagtgtaggagtagggtgctcgactaccgnggggccgaaggaacacgtggtacctaccgtcctcctacacgtccctaccgaccgaacgggcccagtcccggttcccttcccccgtggaccctaccccgtccctacgaacgcgtacctacccgg

SEQ ID NO: 44087 - DNA, 816 bp, Homo sapiens
  misc_feature: GYAE6OF02FMNXP.31.14.B03.1.454.CMB.1.raw
  modified_base (268)..(268): a, c, t, g, unknown or other
  misc_feature (268)..(268): n is a, c, g, or t
  modified_base (797)..(797): a, c, t, g, unknown or other
  misc_feature (797)..(797): n is a, c, g, or t
tcagcagtagacgtcacgaccggtgctcgatttagtgtgagtagtttgggctgagctgggttttcctcgttgctcttttaagaggtgtccagtgtcaggtgcacctggtgaatcgtggggagcgtgtccgctgggggtccctgagactctcctgtgccatgtctgcgtctgaatttcatcctcaggcacgtatggctagtgcctacgtcgggtcccgccacgggccccaggaccgaaacgggacgtggtaggtgggtgacttatttanactagtttgagttaggaagtaaactttaaaaaagtttccgcgtaacgtaccgttaccggttaagggacggtaccgtactttacccaccgtaactccctaccggtaacggtacccgtaacccctttaccgaaaccacgttacgtaccgttaggttaaccttacctaaccgtaaacgtacgtaaaccgttaggttacgggttacggaacgttaacgggtttaacgaaaccggtacgtaaaccgggttaaccttaaaactttttacggtttagtttacggttaacggaaccggtttaaaacggtttcgttttaccgggttcggtttaacgtacgtactaacgtacgttaagtggttaacgggtacggtcggggttacgtaccgtacgaccggtaccggtcggggaccgtaacgggaactccggttacgtaccgtacccgttccgtcgtccgaccgtaccccgttacgaccgtaaccggtccgtaaccgttccccggtacccttcccgtcgtacccgttcccttaccgtaacnccggtacctccgtacccgg

SEQ ID NO: 44088 - DNA, 891 bp, Homo sapiens
  misc_feature: GYAE6OF02JXRQ7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtcctgagactctcctgtgccatgtctgcgtctagaattcactcctcaggccactagtggcagtcgctcgtcgggtccgaccgacggccccaggacgaagggcgtgggaggtggggtcgtactagttttaactaacttaagtttggaacgtagggtaaagtaaaaagttttaaaaaacgttttccgacgtaacggtaccgttaccggtaaggaacgggaccgtacttaccactactcctaccgaacgtacccgtaccccttaaccaactacgtaccgtcttacgtacctacctaacctaaagtacgaacgtacggttagggacgttaacgtacggtaacggaaacgtaaccggtaaccgtaactttaactttaagttttacggtacggttaacggtaacggtaaacggtttacgttttacggggtttacgggtttaaccggtagttacgtaacgttaaccggttaagttacgggttaagggtaacggttacggggtaggtacccgttaccggaaccggtaccggggtaccgggtaaccggaacgggttaaccgtaccgttaccggttacccgtcccgttaccgttcccgtaccgtaccgtaaccccgtacccggtaacccgggaacccggttaccccggttaaccggttcccccgggtttacccccgttaccccggttaccccggtaacccccgttacccccgttacccgtacccggtaaccgtacccggtaccccggttaacccggg

SEQ ID NO: 44089 - DNA, 882 bp, Homo sapiens
  misc_feature: GYAE6OF02F9K99.31.14.B03.1.454.CMB.1.raw
  modified_base (265)..(265): a, c, t, g, unknown or other
  misc_feature (265)..(265): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtcgggtcccgaccgacggccccaggccgaagggactgggaggtgggtggctattttanaactaatttggataggaactaaattaaaaacttttcgactaacgtaccgttcggtaggaacgggtcctaatcccaactactcctaccgagaccgtacccttaaccgaacctataccgtctacgtacttaccctaacctaaatacgtaaactaggttcgggtaataacgtaggttaacggaaaacgtacccggaaccgtaaccttaaacttttattttacgtttacggtagtaacggttaaaagtacggtttttcgggttacgggtttacggaacgtacctacgtaactaagggttacggtagggtaacgggtttaacgggtcgggttaccctacggaaccccggtaccggggtaccgggtaaccgggtaaaccgggtaacccgtagggtttacccggaacccggttacccgttccccgttacccgttaacgacccccggttccccttaaccccgaaacccggggttaacccggggaacccccttaccggggttttaccccccggtttacccccgttacccccccgggttaacggttacccccccccgtttaacccgttacccccccggtaaaccggaaaccccgggtttaccccgtaccccggttaaacccccgggg

SEQ ID NO: 44090 - DNA, 839 bp, Homo sapiens
  misc_feature: GYAE6OF02HV4FF.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcggtgggtccgggccgtcggggggtccctggagactctcctgtgccatgtctgcgtctagaattcactcctcgaggcactagtggcagtgctacgtcgggtcccaccgacggccccgagggacgaagggtacgtagggaggtggggtggctaatttaataacgtaagtttggagtagggtaaagtaaaaattaaaaaacgttttacgacaacgtaccgttaccggtagggaacggggtaccgtaacttacccaaccgtactaccgtaccgaacgaccgtaccccttaaccgaaacctacgtaccgtcttacgtacttaccaacctaaagtacgaaacgtagtagggtacaacggtaagtagaaacgtaccgaacggtaacctaaagttttattagttacggttaggtaacggtaaagtttcggtttacgggtttacggtacggacgtaacctaagttacgtaaggttagggtaggtaacgggttaacgggtcgtaccgtaccggtaccggtaaccggggtacggggtaaccccggaaagggttaaccgccgggttaccggtacccgttaaccgttcccgtacccgtaccgtacccgaccccttacccggaccggtaacccgggtccctaaccgggttccccgttacccccgtccccggttcggaccccctaccccgttaccccgaaccgaacgtcccggaaccccgttaccggg

SEQ ID NO: 44091 - DNA, 949 bp, Homo sapiens
  misc_feature: GYAE6OF02HJRJZ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctgggggtccctgagactctcctgtgccatgtctgcgtctgaattcatcctgaggctactagtcggctatgacacgtcgggtcccgaccgacggcccccagggaccgaaaggggactgggaggtggggtcggtacttagtttactaacgtaattttaggagttagggaagttaaatttaaaaaaacgtttttaccggacgtaacggtaaccgttaccgggtaagggtaaaccggggtacccggttaactttacccgaaccccttaaacgtttcccgtaaccccggtaaacggtacccggtttaacccccctttaaccccgaaaaccccgttaaccgttaaacccggtccgttacgttaaacttacccgttaacccgtaaaacgttaccgtaaacgtacgtttagggtacgttaacgtacggtttaacggaaacgttaacccggaacggtaaccttaaacgtttttaacgttaacgttttcggtaacggtaaacggttaaaaacgttttcggtttttaccgggtttacgggtttacggtaaccggttacttaaaccgttagtaagttagggttaagggttaggtttaacggggttcggttacctacggtaccgtaacccgggtcgggggaaccgtaaacgggaacccgtcgttacgggtaccgttacccgttccgtacctcccggaccgttaccccgtaccgaacccggtacccgggtacccttaccggttccccggttacccccgttaccccccggtcgtaccccccgttacccggtcccctaacccggaccgtacccgacccgttacccggg

SEQ ID NO: 44092 - DNA, 893 bp, Homo sapiens
  misc_feature: GYAE6OF02FXRSG.31.14.B03.1.454.CMB.1.raw
  modified_base (561)..(561): a, c, t, g, unknown or other
  misc_feature (561)..(561): n is a, c, g, or t
  modified_base (858)..(858): a, c, t, g, unknown or other
  misc_feature (858)..(858): n is a, c, g, or t
  modified_base (876)..(876): a, c, t, g, unknown or other
  misc_feature (876)..(876): n is a, c, g, or t
  modified_base (882)..(882): a, c, t, g, unknown or other
  misc_feature (882)..(882): n is a, c, g, or t
  modified_base (889)..(889): a, c, t, g, unknown or other
  misc_feature (889)..(889): n is a, c, g, or t
tcagcagtagacgtcacgaccggtgctcgatttagtgtgagtagtttgggcgtgagctgggtttcctcgttgctctttaagaggtgtccagtgtcaggtgcacctggtggaatcgtggggagtcgtggtccggcctgggggtccctgagactctcctgtgccatgtctgcgtctagaattcaattccgtcaggtccaacgtagtggcagtgctacgtgggtcccgccgaaccgggcccccagggtaccgaaacgggtcttagggacggttcgggtggtacctaagttttaacttaaccgttaattttaggaagttgggaaacgttaaaaacttttaaaaaaacgttttaccgggactaaaggtaccccgtttacggacggggtaaaacccggggtcccgtaacgtttaccccaaacccggttcttaacccccgtttaaccggaaaccggtaacccggttaaacccccctttaaccaaaaccccccgttagttaaaccccgggttcccttaaggttaaccgttcccgttaaaacctaaaaacggttccgtaaaaaacccggnggtttacccgggtttaaggaacggtttaaccggttaaggaaaacggaaccgttaaaccggggtctttaaaaacccgtttgttttaacttcggggtaaagtaaccgggtaaaaagttaccggttttcggggttaacggtttacgaacgtccttaaggtaactaggttcgggtaggttaaagtcgggttaccgggacttaccggaacctcgggtaacgggaccggtagttaaacgacgttcgaccgttaccgcttccgtacacccgtcctaccgacgtaccggccgtacgtccttcccnccgtgaccctccgtaccngtaacnccgtacnccgg

SEQ ID NO: 44093 - DNA, 844 bp, Homo sapiens
  misc_feature: GYAE6OF02HQR3V.31.14.B03.1.454.CMB.1.raw
  modified_base (177)..(177): a, c, t, g, unknown or other
  misc_feature (177)..(177): n is a, c, g, or t
tcagcagtagacgtcacgaccggtgctcgatttagtgtgagtagtttgggctgagctgggtttttcctcgttgctcttttaagaggtgtccagtgtcaggtgcacctggtggaatcgtgggggaggcgtggtccggccgtgggggtccctgagactctcctgtgccatgtctgcgtntagattcatcctcagctactagtggacagtcgacacgtcgggtcccgccgaccggccccgagggaccgaacgggtcgtgggacggtggggtcgtacttaagtttaactaacgttaagtttgagttaggaaagttaaaactttaaaaaacgttttacgacgtaacgtaaccgttaccggtaacgggtaaccggtaccgttaaccttacccaaccctacgttaccccgtaaccggaacgtacccgtaacccccttaacccgtaaacctaccgtaccgttacgttacgttacttacctaacctaaagtacgtaacgtagtacgggtacgtacgttaagtaacgaacgacgtaaccgtaactttaactttaagttagttacgtaacggtaacgttaaggttacgttttcgggttacgtacgaacgtacaacttacgtaaggttcggaaaggttaggtacgggtcgtaaccgtacggaccggtaccgggtaacgggaaccggtaacgggtaccgtacgggttaccgtacccgtaccgttacccgcccggtacgaacccgttcccgtaacccggaacccggtaccgggttccctacccggtttccccggtccccttacccccggcggttaccccttaccccgtacgtaaccgaacggtccgtacccgtacggg

SEQ ID NO: 44094 - DNA, 654 bp, Homo sapiens
  misc_feature: GYAE6OF02H6KOJ.31.14.B03.1.454.CMB.1.raw
  modified_base (272)..(272): a, c, t, g, unknown or other
  misc_feature (272)..(272): n is a, c, g, or t
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttaggggtttaggggggagctacaacaggctaggcaggggccagcaagatggtgttgcagacccgaggtcttcatttctctgttgctctggatctctggtgccgtacggggacagtcgtgatgacgcctagtttccagacctcccgtggctgtgtctcgtgggcgagacggcccacatacaactgactaacgtccagccagtagtttgttttactcggacccccaanaactaacaacttactagtcttaggaccagacaaggaaagtggacacgacctacctaaactctagtacttacgtgtccttacgcccggtntacgtccgggttaccacgtntctagtcggctaggtcggtgtacgggacttattccactcctacactagcacgctacgctgcgagcgtagagtgtcgtgacttagtttactacgtgaacgtacgactaaacttacgtttaactttacctttcgttaccgttccttacgggtttacgggaccggtaacggtaaccggtaagggttagtacgtaacgtaaccgtaacggttacgttacgggacggttacgaccgtacgtaccctaggtttccctagtttacccgttacttaccccg

SEQ ID NO: 44095 - DNA, 787 bp, Homo sapiens
  misc_feature: GYAE6OF02H7INE.31.14.B03.1.454.CMB.1.raw
  modified_base (193)..(193): a, c, t, g, unknown or other
  misc_feature (193)..(193): n is a, c, g, or t
  modified_base (318)..(318): a, c, t, g, unknown or other
  misc_feature (318)..(318): n is a, c, g, or t
tcagcagtagacgtcacgaccggtgctcgatttagtgtgagtagtttgggctgagctgggttttcctcgttgctctttaagaggtgtccagtgtcaggtgcacctgatggaatcgtgggggaggcgtggtccggcctgggggggtccctggagactcgtcctgtgccatcgtctgcgtctgaattcagtcctnagcactagtggcatgctacgtcggccgccgacggccccaggcgaaggacgtggaggtcggtgactatttagtactattgatcggataaattaaaaatttcactaagactccgtaggacggacctntaccaccagtactaccgtaagacgtaccccttaccaaaccgtataccggacttagtactacccttaaccgtaaacgtacggtaaactacgttagggtaccgtaacgttacgttaggaaacgtacccgaaaggttaacccttaaaacggttttatttaaggtttacggttacggaaaccgttaaaagggtaacgtttttcggttaacgggtttacggaaaccgtacgtaattaccggtaaggttacgagggttaatacccgggggttggaacccgttaccgaaccggtacccgggtagggggccgaaaccggggtacgtaaccggtttccgggtaccttaacccggaccttttccgaaccgtaccggtaccccttcccgaaaacccgggtcgggtacccctacggttcccgttaccccgttaccccgtagtcccccgtaccctaccggtccctaaagggccttaccccgg

SEQ ID NO: 44096 - DNA, 755 bp, Homo sapiens
  misc_feature: GYAE6OF02IBBJJ.31.14.B03.1.454.CMB.1.raw
  modified_base (500)..(500): a, c, t, g, unknown or other
  misc_feature (500)..(500): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcggtcgggtccggccgtcgggggggtccctggagacctctcctgtgccatcgtctgcgtctgaattcactcctacgaggcaactagtggcagtcgccacggtcgggtccccgaccgaccggccccgagggtaccgaaaggggtccgtgggacgggtggggtgtactaatttaagaacttaagtttaggagttagggaaaataaaaacttaaaaagtttcgctaacgtaccgtaccggtaggaacgggtacctactaccactactaccgacgagacctacccctaacaacctatacgcttagtactacctaaccaagtaccgaagtagtacgtagactaaggtaacgaaacgacgaacgtaacttaactttagtnttgaacgtaagaacgttgtttaccggtttgtacgagtactagtacaggtaggtaggtagtgggtcgacgtacgcgaccggtcgggaaccaggtactacggttacggacccttccggtcctcgtaccctacggacccctacccgaccgggtacccgtcccgttaccgggttccccgttacccccgttcccccggcccgttaccccgacccccgtttaccggaacccgtaacggccccgttaaccccggtacccggg

SEQ ID NO: 44097 - DNA, 911 bp, Homo sapiens
  misc_feature: GYAE6OF02JI1SL.31.14.B03.1.454.CMB.1.raw
  modified_base (188)..(188): a, c, t, g, unknown or other
  misc_feature (188)..(188): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcagtgccacgtcgggtcccgacccgacggcccccgaggtaccgaaagggactgggaggtggggtaggcctaatttaataacgtaagttttggagtgggaagtaaagtttaaaaaaaatttttaccggacgtaaggtaaccgttacccggttagggaaaccgggggacccgtaattacctacccgaattcccgtacccgaacggaaccggtacccccctttaaccgaaacccctaacgttaacccggtccgtttaacggttacttacccttaaccccaaaaagttaccgaaaaccgttacgttacgggttacgaacggttaaacggtttacggaaaacggtaacccgtaaacccgggtaacttaaaaacctttacgttttaacgtttacggttacgggtaaaccggtaaaaagttaaccggttttacggtttaccggggtttaccgtaagtaccgtaacgttaacgtaaagttgggttaacggaaaggttaggggttacggtccgttaaaccgaccgtaacccgggtcggggaaccgtaaacggggtaacctaacggttccgttaaccggtaccccgttcccttaccgtccgtaaccggtcccgtaccccgtaaccggaaccgggtccccgttaacgtcccggtttaaccccgttccccgttccggaaccctccccgttacccgtaacctacggtaccgcccgttaacccggg

SEQ ID NO: 44098 - DNA, 773 bp, Homo sapiens
  misc_feature: GYAE6OF02FR4M5.31.14.B03.1.454.CMB.1.raw
  modified_base (188)..(188): a, c, t, g, unknown or other
  misc_feature (188)..(188): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtgggggagcgtggtccggcctggggggtccctgagactctcctgtgccatgtctgcgtctgaattcatccctnaggccactagtggctatgccacgttcggggtcccgccgaccgggcccctaagggccaaaaggggcctgggaagggttgggtcggacttatttaatactaagttttgagtggaagtaaattaaaaaagtttcgacagtacttaccggaggaacgggcctattccgaacctatcctacagacctacccgtaccaaccatcgctagtactcctacctaatacgaactagtggtagacgtagttacggaacgtaccgtacggacttaaactttagtttagtttcggtacgaacggtaaagttacgttttcgttaggggttaccacggtaactacgttaacgtagttagggtaacggtaggttacggggttcgacccgttacggaaccgttacccggggtacgggaaccggtaagggtacccgtaacgggtttccggtaaccccttaccggttccctttacccggacccgtacgtccccggttaccaaaacccggtcgggtaccccctagggtttacccccggtcccttttaccccgcggtaaccccttcccctaccggttacccgaacgttccgaacccgttacccggg

SEQ ID NO: 44099 - DNA, 679 bp, Homo sapiens
  misc_feature: GYAE6OF02GDR92.31.14.B03.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggagcgtggtccggcctggggggtccctgagacctctcctgtcgctagtgtctgcgtctagaattcatcctcgaggctactagtggacatgccacggtgggtccccgccaccggccccaggacgaaagggctgggaggtggggngacttaagtttanaacttagttgagtaggaagtaaattaaaaatttacgataacgccgtacgaggaaggcctataccacnctctacgacgtacgtaccctacaaccactacgctagtactacctacaatacaactagtcggtanactggtaagaactaaccgcgtaactaatttacgttatagtggaacgtaaagtcgtttacggttaggttacgacgtactaacgttataagtggtggtaaggtacgggactaccgacggtaccgaccggtcggggaacgtacgggacctacgggtcgtaaccgtcctacctcgtaccaacggtcccacgtaaaccggccgtaacccgtcgttccccgtacccgttcccgacggtcccctaaccccgtaccgtacgaaccggtaccaccgtccgg

SEQ ID NO: 44100 - DNA, 761 bp, Homo sapiens
  misc_feature: GYAE6OF02GH0KZ.31.14.B03.1.454.CMB.1.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagacctctcctgtgccatgtctgcgtctgaattcatccctcaggcactagtggcatgcacgtgggtcccnccgacggcccaggcaagggctgggaggtgggtcgctaagtttanactaatttgagtaggaagtaaattaaaaacgttttcgacacgtaccgtcgtaggaacgggtcctacttaccgaccgtattccgtaccgacgtaccgtaccccttaccgaaacacgtaccgtacgttacgtacttacctaacgaaactcgaaactagtagggtacgaacgtaggttaacgaacgtaaccgaacggtaacttaaacttttaagtacgtttcgaacgtaacgtaaagttcgttttacggttacgggttcgaacgtcgtaactacgtaaaggttcggtaggttaacggtggggtcgccgttaccgaccgtacccggtcgggggaccctaacggggaacctaccggttacggtacccgttaccgttacctaccgtccgtaccgcccgttacccgacccggtaaccggtacccgtacgttcccggttcccttacccccggtggtaccccttaccccggtcccgtaacccgaccggtacccgtcccgtaacccggg

SEQ ID NO: 44101 - DNA, 659 bp, Homo sapiens
  misc_feature: GYAE6OF02GMSW4.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccacggccccagggcaacgggactgggagtgggtgctatttatacatttgatggataattaaaaaacttttacgacagactccggtaggaacgggccgtattcaccgatcctaccagacgaccccttaccaacactacgctgtactctaccaaatcgaaacagtggtagactagttaggaagacgaacggactaaactttattaattggtagacgaaagtcgtttacggtttggtcgagtactatacgaagtggtaggtaagtacggggtgccgtacgacctaccgggtaggggaccgaaggggaacctacgttcgggtacctacccgtcctcccgtacaccggtccctaccgaaccgtaaccgggcccctacggttcccggtccctttcccccggtggtacccctaccccttacccgtaccgaacggtccgaccctacccggg

SEQ ID NO: 44102 - DNA, 752 bp, Homo sapiens
  misc_feature: GYAE6OF02JB7SU.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccnccaggccccaggcaagggctggagtgggtgctatttatactaatttgatggagaataaaaaattttacgcagactccgtgaagggccgattcaccatctccagacgacccttccaaccatacgctgtatctacaaatgaactatggtgactagttagaagacacggactaacttatttagttgtagaccgtaaaagtacgtttcggtttacgggttacggaagtccgtaattaaccgtaaagttcgggttaagggtaaagttaacggggggttacgggaccgttacccggtaaccgtaaccccgggttcgggggggaacccgtaaacgggggaaaccctaacggttacgggtacccgtaaccccgggtttccttaccccgtttaccgaacggtacccccgtttacccgaaccccggtaaaccggggtcccctaaccggttcccggggtttacccctttccccccccggttacgggtaccccctaaccccccggttccccttaaccccggaaacggtaccggtacccttaacccccggg

SEQ ID NO: 44103 - DNA, 707 bp, Homo sapiens
  misc_feature: GYAE6OF02IQ871.31.14.B03.1.454.CMB.1.raw
  modified_base (222)..(222): a, c, t, g, unknown or other
  misc_feature (222)..(222): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtgggggtccctggagactctcctgtgccatgtctgcgtctgaattcactcctcaggcactatggcagttgctacgtggggtcccnccgacgggcccccagggacgaagggactgggagtggggtggcctatttatacatttgatggagtaattaaaaaattttacggctaagtaccgtcgtggaacgggaccgtattaccaccgattcctaccacggaccgacccttacccaacacgtcgcttagtactcctaactaaactagaacagttagganacgtagttagaagaccgacggactaacgttaatttagtagttacggacgtaaagttacgtttacggtttacggttagacgtactagtactaagtggttagaggttaggtcggtacgtcgtaaccgtaccggcgggttaccaagggtactacgtgggttacccaccggttacctcccgtacgaccgggtcccacccgaccggtaaaccggaccccttaccgttccggttcccccttaccccgtaggacccccttaccccggttcccgacccgtaacgtcccgtcgtaacccccggg

SEQ ID NO: 44104 - DNA, 836 bp, Homo sapiens
  misc_feature: GYAE6OF02GQQK3.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctgggggtccctgagactctcctgtgccatgtctgcgtctgaattcatcctcaggcactatggcatgctacgtgggtccgccgacggccccaggacgaacgggtactgggaggtgggtggtactatttactacgtaagtttgagtggtaagtaattaaaaaattttacgactaacgtacttaccggtaggaacgggtccgtacttaccgaacctataccgtaccgaagtaaccgtaaccccttacccaaacctaacgttaccgacttacgttaccttacctaacctaaagttacgaaacgtacgttagggtacgaacgttacggtacggtaaacgaacgtaaccgtaccttaaacgtttactttaaggtttcgtacggtaacggtaaaagttacgttttagggtttacggtttaccggacgtacgtaacgttaccgtaaggttaggtacgggttaggttacggggttacggacccgtaccggaaccgtaccgggtacggggaccgtaaacgggaaccgtaccgttagggtacccgttaaccgttccgttacccgttaacgacccgtacccttaccccgaaaccggtaacccggggcccttaaccgggttccccggtttaaccccgttcccccggtaccgtacccccgttccccccgttaaccgtaaccccggttaacggacccgttccccgttaaccccgggg

SEQ ID NO: 44105 - DNA, 1035 bp, Homo sapiens
  misc_feature: GYAE6OF02H30RM.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcaggcactagtggctagtcgcacgtcgggtcccgaccaacgggccccagggaccgaaacgggtcgtgggtagtggggtgactatttaagtaactaaagtttggaagtaggtaaagtaaaatttaaaaaaacgttttcgaacgtaagtaccgttaccggtaagggtaaaccgggtaccgtaacttacccgaaccgtacttacccgtaccgtaacgtaacccggtaaccccctaaccgtaaaacccgtacttaaccggttaccgtacgttaacttacctaaaaccgtaaaagtaccgtaaacgtaacggttcgggtaacggtaaccctttaagggttaaacgaaaaccggtccgtaaaccgggttaaaccttaaaccgttttaaagtttacggtttaacgggtaacggtaaacgttaaacggtttaaggttttacccggggttttacggttaaaccggaacgttaacaaacggttaacggttaaaggtttcgggtaaaggggttaaacgggtttacgggggtttaaccggtacccggttaacccgggaacccggttaaaccccggggttacgggggggaaacccccggttaaaaacgggggttaaccctaacggggtttcccgggttaacccccgtaaaccgggtttccccccgttaccgaaaccccgggtttaggaaccccccctttaacccccgggaaccggttaaccccggggtacccccgttaccgggttttaacccccggtccccccgtttttaacccccgggcccgggaccccctttaaaccccgttcccccccggttaaaacgggccgtttaacccccggtaccccggtttaacccccgggg

SEQ ID NO: 44106 - DNA, 687 bp, Homo sapiens
  misc_feature: GYAE6OF02FIKVU.31.14.B03.1.454.CMB.1.raw
  modified_base (217)..(217): a, c, t, g, unknown or other
  misc_feature (217)..(217): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggagcggtggtccggcctggggggtccctgagactctcctgtgccatgtctgcgtctgaattcactcctctaggctactatggcatcgcacgtgggccnccacggccccgaggccaagggtcctgggagtcggggtcgtcatttagaacctaagtttcgatagggactaaatttaaaaacctttcgacgtagaccgtccggtaggaacggtccattccaaccgntcctcacgacaccttaccacctataccgctgtactcctaacgaatcgaacnggtagttgacagttacgaataccgacggtactaaccgtttnttacgttgcgtaacgaagtacgttcgtacgggttacacgactaactacgaactgggtacggtacgggtacggtacggaccgaccgtaccggtaccggtcgggtaccggaacgggtaacctacggtaccgtaccgttaccgaccttaccggacctaccggacccttaccgaaccggaaccgggtaccctaccggttacccgggttacccttccccgcggtacccaccctacgtacccacggacctcgtacccgg

SEQ ID NO: 44107 - DNA, 1006 bp, Homo sapiens
  misc_feature: GYAE6OF02G7NH1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccgacggccccagggaccgaagggactgggaggtggggtggctatttataactaatttgagtaggaagtaaattaaaaaaagttttacgacgaacgtactaccggtaggaaacgggcccgtaactttccaacctaacttccgtacccaaggtaaccgtacccccttaccaaacctactaccggtctacgttaacttcctaacctaaaatacgaaaccgattacgggacgtaaccgtaaggtttaggaaacgtaaccgaacgggtaaccttaaaacgttttaaagttttaagtttacggttacggtaaccggtaaaaaggttacgtttttaccgggttttacggggtttaccggtaaacggtacctaaacgtttaaccgtaaaaggtttcgggttaacggggtaaacgggtttaagggggggtttaccgggtacccgttaaccgggtaaaccccggtaaccggggttttacccggggggaaaccccgggtaaaacggggggttaaaccccgtaaccgggtttaccgggggttacccccttaaaccccggggtttccccgtttaaccccgttaaccccggtaaccggtaacccccccgtttaacccccggaaaccccggggtaaaaccccggggtccccccgttaacccgggttttaccccggggtttacccccccccgtttttacccccccgggtaccccgggtaacccccccttttaaccccccggttaacccccgtttaaccccgggtaaaaccccgggtacggtaccccccgttaaaccccccggggg

SEQ ID NO: 44108 - DNA, 694 bp, Homo sapiens
  misc_feature: GYAE6OF02H2V16.31.14.B03.1.454.CMB.1.raw
  modified_base (190)..(190): a, c, t, g, unknown or other
  misc_feature (190)..(190): n is a, c, g, or t
  modified_base (220)..(220): a, c, t, g, unknown or other
  misc_feature (220)..(220): n is a, c, g, or t
  modified_base (462)..(462): a, c, t, g, unknown or other
  misc_feature (462)..(462): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctggagactctcctgtgccatgtctgcgtctgaattcatcctnaggcactatggcatgctacgtcgggtcccnccgacggccccagggaccgaaggggctgggaggttggggtggactagtttaataacgtaattttgagtaggaagtaaaatttaaaaaagttttacgactaagtacctcggtaggaaacgggcccgtattaccaacctatccgtccgaagaccgtaccccttaccaacctagtaacgtcttagtactccaactaaatcgaaactgtacgtagacgttaggtagaacgacgacgacttaacttnttagttgagaacgtaagtcgtttcgggttcgtagatacagtcaagtgtaggtgtacgggtgccgtagacctcgggtagggccgaaggtaccgtacgtacggtaccctcgtctccgtaccgaccgtccaacccgtacccggtacccggtaccctaccggttccccggtacccgtttcccccgcggtaccccttaccccgtacccgtacccgtaaacgcccgtacgtaccccgg

SEQ ID NO: 44109 - DNA, 602 bp, Homo sapiens
  misc_feature: GYAE6OF02FVMRX.31.14.B03.1.454.CMB.1.raw
  modified_base (255)..(255): a, c, t, g, unknown or other
  misc_feature (255)..(255): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcactggtccgccaggccccaggcaagggactgggagtgggtggctagtttanacatttgatggagaataaaaattttcgacagactccgtgaagggccattcaccatctccagacgacccttaccaaccataccgctgtatctaccaaagtgaacatggtagactagttagaacgacacggctaacttattatgtgacgtaaagtnttcgttgttcgagtcattacaagtgtagagtagggtcgctacgacctaccggtagggacccaggggaacctacggttggtaccaaccgttcctaccgtcacgtccctaccgaaccgtacgggcccctaagttcccggtcccttcccccgtggtaccctaccccgtccgttaacccgagtaccggacgtacccg

SEQ ID NO: 44110 - DNA, 882 bp, Homo sapiens
  misc_feature: GYAE6OF02JJD1U.31.14.B03.1.454.CMB.1.raw
  modified_base (273)..(273): a, c, t, g, unknown or other
  misc_feature (273)..(273): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtcgggtccgccaggcccccaggaccgaaggggacctggggagttcgggggtggtacctattttanaacttaagtttgaagtgggaagtaaatttaaaaaacgttttacgacgtagtacgttaccggtaggaacggggtaccgtacttaccgaacctagtacctccgaacgaccgtaccccttacccaaactactaccgtcttacgtactaccgtaaccaaagtaacgaaacgtagtacgggtcgtaacgtaacggttaacggaaacgtaccggtaaccggtaacccttaaaaccgttttaagtttaacggttttacgtaacggtaaccgggttaaaagtttaccggttttacgggtttttacggggttaacgtaaccggttactaaacgttaaccggttaaacggttagggttagggtaaagggttacggggttccggtaccgttaaccggtacccggtaccggggttacggggaaccggtaaccgggtaacgtaaccgttccgggtacccgtaaacccgttccttaccgttacccgaaccgtccccttaccccgaaccggtaaccgggtcccgttaacggttcccccggttaaccctttcccccccgggtaccgtacccccgtaccccgttacccgtaaccccggtaacggtaccccgtaccgtaaccccggg

SEQ ID NO: 44111 - DNA, 830 bp, Homo sapiens
  misc_feature: GYAE6OF02ITZEY.31.14.B03.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggctgagcgtgggtttcctcgttgctctttaagaggtgtccagtgtcaggtgcacctggtggaatcgtggggaggcgtggtccggcctgggggtccctgagactcgtccgtgtgccatgtctgcgtctgaattcatccgtanaggcactagtggcagtgccacgtcggggtacccgcccaaggccccccgaggaccgaaaggggtacctgggaggtgggtcggtacctagttttaacgactaaagttttgacgttaggaagtaaattaaaaaacgttttaccggactaacggtaccttccgggtagggaaaccgggtcccggttaacttacccgaaccttagtcctacccgacggtaccgttaaccccgtttaccaaaccgtactaaccgtccgttagttaacttcccgtaaccctaaagttaccggtaaacagtttagggtaccgtaagtacggttaggaaaccgacgtaacccggtaacttaaaccttttaacgttagtttagttaccggtaacgtaacggttaagttttccgtttacgggttacggtaacgtacctaaggtccctaaaggttgggttagggtaacgttaggggtccggtacgttcccgaccgtaccggtacgggccgtaaacggggactacggtacggttacccaccgttaacccgttctacgaaccgttccctacccggaaacccgtccggtaacccgacggttaccccggttaccctttccccgaggttaccctaccccgttccaaccgtacgtaccgctaacccgg

SEQ ID NO: 44112 - DNA, 706 bp, Homo sapiens
  misc_feature: GYAE6OF02GESKQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtggggtccgccacgggcccccagggccgaaaggggactgggaggtgggtggctatttatactaatttgagtggagtaaattaaaaaattttacgacaacgacctccggtaggaacggggccgtattaccaccattcctccgaagaccgtaccccttaccaacctataccgtcttagtactcctaaccaaatacgaaactagtggtacgaactagttagaacgacgacggtactaactttattattgtagtacgtaaagttgttcggttacggttagacgactatactaagtggtaggtaagtagggtcggtacgtacggtaccgtaccgggtcgggggtaccgaagggtaacctacggttcggtaccgaacccgttcctacccgtacgaccgtcccacccgaaccgtaccgggtccctacggttcccggtacccctttcccccggtacggtacccctaccccctcccgtaacccgaacggtaccgtaccctaccccggg

SEQ ID NO: 44113 - DNA, 815 bp, Homo sapiens
  misc_feature: GYAE6OF02IUY0Z.31.14.B03.1.454.CMB.1.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgacacgtcgggtccnccacggccccagggaccaaaggggcctgggaggtgggtggtacattttanactaatttggataggaagtaaattaaaaagttttcgactaagtactaccggtaggaacggggcctaagttccaacgtatccgtaccaagaccgtaaccccttaccaaccacttaaccgctagtacgtacctacctaaacgacgaactacgtcggtactaacgtaagttggaaacgtaaccacgggtaacctaagtttactagtttacgtacggtaacgtaaacgttacgtttacgggtttaacgggttacgaacgtacgtaaacgttacctaaaggttacggttagggttaacggtacggggttagacccggttacggtaaccgtaacccggggttcgggggaacccggaacgggtttaaaccggaccgtaccgggttaacccgtccccggttaccctaccggttaccgaacccgttcccctaaccggtaacccgtaaacccggggtccccgttaaccgtttccccggttcccccggttaaccccgtttcccgggacccttacccccgttaaccgtaacccggtacggaccgttcccctaaccccgggg

SEQ ID NO: 44114 - DNA, 922 bp, Homo sapiens
  misc_feature: GYAE6OF02IQURL.31.14.B03.1.454.CMB.1.raw
tcagcagtagacgtcacgaccggtgctcgatttagtgtgagtagtttgggtttaggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgaccaacgtccacgaccaggtacgtttagtttttacgttccggacccccaactaaactaaactaaccttaactttacgacgtttacggtaaccagaccaaaggaaaacggtacggacacggtaccctacctaaaccttcctagtactttacgtcgggtaccttacccggtacccgggtccgtacggttacccggggttaccctaaaccgtacttacgtacgttcggacgtacggtccggggttaccgtacggggaccttacgtttccctaaccgttcccgttaccaacccttacgtccgaacggtacccaacggttaccccgtaggacccggtaacgggtaccggttaacggtaaacgggtacggttacgggttagggttaacctttaaacggggtttttaacttttaccggttaccggtttaaaccggtaccggtaaaacccttaaaccgtttaacttttaaccgtttttaaacccgttttttcccggtttttaaacccgtttacccgttttaacccgggttttacccggggggtaaacccgggttaaaccgggggtaaacccgggttaagggggtacgggttaaccggtaacgtttaaccgggtaaaacccggttccggttagggttaacccgggtacgttacccggtaacctacccggttaaccgttccggtttacggttttacccttacgttaaccccgg

SEQ ID NO: 44115 - DNA, 600 bp, Homo sapiens
  misc_feature: GYAE6OF02F77CB.31.14.B03.1.454.CMB.1.raw
  modified_base (262)..(262): a, c, t, g, unknown or other
  misc_feature (262)..(262): n is a, c, g, or t
  modified_base (328)..(328): a, c, t, g, unknown or other
  misc_feature (328)..(328): n is a, c, g, or t
  modified_base (376)..(376): a, c, t, g, unknown or other
  misc_feature (376)..(376): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctggggggtccctgagactctcctgtgccatgtctgcgtctgaattcatcctcaggcactatggcagtgcacgtgggtccgccacggccccaggcgaagggactgggaggtgggtgctatttaanacgtaatttgatggagtaattaaaaatttacgacagtactaccgtaggaacgggccattcacatcnccagactacctccaaccatacgctgtactctactaaatgaacatgganactagtagaacgacacgtactaacttattagtgtgacgtaaagtgtttcgttaggtgagtctaatacgtaagtggtaggtagtagggtcgacgttacgctacggcgggaccgacgggactcgtacggtaccgcgttccgtacncgactcccacgaccgacggccctacggtcccgtccttaccccgcggtaccctccccgtactaccgacgtaccgcctaccgg

SEQ ID NO: 44116 - DNA, 638 bp, Homo sapiens
  misc_feature: GYAE6OF02J1OIT.31.14.B03.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
  modified_base (629)..(629): a, c, t, g, unknown or other
  misc_feature (629)..(629): n is a, c, g, or t
tcagcagtagacgtcacgaccggtgctcgatttagtgtgagtagtttgggtctgagctgggttttcctcgttgctcttttaagaggtgtccagtgtcaggtgcaccgtggtggaatctgggggaggcgtggtcccggcctggggggtccctgagctctcctgtgccagtgttcctgcgtctagaatttcatcctcgaggcactntggccatggctaacgtgggtccgaccgnggccccaggctaagggctggngtgggtgactagtttanactattgataggagtaattaaaactttgacacggtactccgtaggaagggtcctacttcgacctatcctccagacctaccttaccaaccntacgctagttactcgtaacaaatcgaatacgtggtacgacgtgttagaacgacgacgtactaactttatagtttcgtagactaaggtactttcggttggtcgagtctaacgttagaatttggacgggttatacggggttgccgttacgacgttcggacgggtccgaggtaccagtcggacctaccgtccgcctcgtacgccctaccgaaccgcggtccctagtcccgtcccgtttacccgcggtccctcccctaccgtaccgagtaccncgtacccgg

SEQ ID NO: 44117 - DNA, 835 bp, Homo sapiens
  misc_feature: GYAE6OF02JXIPX.31.14.B03.1.454.CMB.1.raw
  modified_base (271)..(271): a, c, t, g, unknown or other
  misc_feature (271)..(271): n is a, c, g, or t
  modified_base (643)..(643): a, c, t, g, unknown or other
  misc_feature (643)..(643): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctagaattcatcctgaggcactatcggctatgcacgttcgggtcccgccacgggccccaaggggaaagggactgggaggtgggtggctattttanactaatttgagttggaaagtaaattaaaaaacgttttacgacgtaacgtaccgttacccggtaggaacgggtacccggtaatttaccgaaccctaattcccgtacccgaacggtaacccggtacccccttaacccgaaaccctaacgttaaccggtaccttacgttaacctttacaaaccccttaaaaagtaccggtaaactaacggttacggggtaacgtaacttagggtttaacgaaacgtaaccgaaccggacttaacgtttaacttagtttacggtagaaacggtaaagttacgtttacggtttcggttacggtagtacctagtacgtaattgggtagtaaggttgggtaggtaccgtcggtaacccncgggttacggggaacccgaaggggtaacccgtacggttacgcccggtaacccgttccgtacccctacgaaccggtccctaacccggaccggtaaccgggtcccttaacggtccccggtttccgtacccccggtaccggtccctaaccccggttcccgaaccgtacgtaccggccccttacccggtaccgggg

SEQ ID NO: 44118 - DNA, 766 bp, Homo sapiens
  misc_feature: GYAE6OF02I21ZR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagacctctcctgtgccatgtctgcgtctgaattcatcctcgaggcactatcggcatcgctacgtcgggtcccgaccacggccccgaggacgaaacgggactgggacggtggggtcgacttagtttaactacgttaatttaggaagtaggtaagtaaaagtttaaaaaaacgttttacgacgtaacggtaccgttaccggtaagggtaaacgggtcccgtaacttaccgtaaccacttcctaaccggacggtaaccgtacccccttacccaaacctacgtaaccgccgttagtactaccttacctaaaatacgaacgtagtcggtacgaacttacggtagaacggaaccaccggtactaactttataagtttgacgtacgtaaagttcgtttagggtttcggttcaagtactagtacgtaagtggttacggtaggtacggtcgtacgtccgtacgtaccgggtcgggacgtaagggtaccacgttacggtacccgtaccgttaccgtcctacgtaccgtcccgtacccgacccgaacggtcccgtacggttcccggttacccccttcccggaccgttacccacccgttacctacccgaacgtccgtacccgtaccgg

SEQ ID NO: 44119 - DNA, 725 bp, Homo sapiens
  misc_feature: GYAE6OF02GJA4W.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtcccnccaggccccaggcaagggctgggagtgggtgcatttanactaatttgatggaagtaattaaaaaattttcgacagactccgtaggaacgggccgattcaccatctccagacgacccttaccaacatacgctgtactctaccaaatgaactagtggtgactagttcgaagaccacggactaaactttattattggtagacgtaaagtcttttacgggttaggtttacgagtcaacgttacaaagtttcggtagggtaagttacgggggttacggccgttaccggtaccgtaacccgggttgggggaacccggtaaacgggggtaaacccgtccggttacgggttaccctaaccccgggtttcctacccgttaccgacgtccccgtaccccgaaccccgaaccggggtccccctacggttccccgggttcccctttccccccggttacccggttacccccctacccgttaaccccgtaaacgggtccgtaccccgacccggttaccccgggg

SEQ ID NO: 44120 - DNA, 774 bp, Homo sapiens
  misc_feature: GYAE6OF02IOPOK.31.14.B03.1.454.CMB.1.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (325)..(325): a, c, t, g, unknown or other
  misc_feature (325)..(325): n is a, c, g, or t
  modified_base (474)..(474): a, c, t, g, unknown or other
  misc_feature (474)..(474): n is a, c, g, or t
tcagcagtagacgtcacgaccggtgctcgatttagtgtgagtagttttgggctgagcgtcggttttcgcgttaggctctttaagaggtgtcagtgtcagtgcactggtgaatcgtggggagcgtggtccggccgtgggggtccctgagactctctggtgacctatgtctgcgtctatattcatcacgagctatancggcagtgcctacgtcgggtcccgaccgacggcccgagggacgaacggggtactggggagtggggtacgnttaatttacaacttaagttttnaaggtggtaaagtaaactttaaaaacgttttaccgganacggttaccaccggttaggaacggggtccgttaaccttaccggaacctcgttccgtaaccgaacggtaacccgtcccttaaccccgaactacgggttaacctctacgttactaaccgtaactaaacgtaacgtaacggaggtttaacgngaacgttaggtacggaaactacggtacgtaactttaacttaagtttcgttacggaagaaccgttaaagttgtttaccggtacggtttacgacggttctaagtacgtaagttcggtaggtaaggtttacgggagtcccgttaggaccccgtaggggacggtaacgacggttaaccgtcggtatacccgggtccttaccgtcttacgacccgtccgccgaaaccgggtcgaccctttaaccggtcgtttcccctcccggagttcccctaacccggcccgttaaacacggtcctcccgtacgg

SEQ ID NO: 44121 - DNA, 702 bp, Homo sapiens
  misc_feature: GYAE6OF02FMY8Z.31.14.B03.1.454.CMB.1.raw
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcagcactatggcatgcactgggtccgccacggccccaggcaagggactgggagtgggtggactatttagactaattgatggaataattaaaaactttacgcaagacttacgnggaacgggtccgattacaccatcctaccaagactaccccttaccaaacctanacccgtnttaggtaactcccgttaaccaaaacgttcgaaactagttacgggttacacgtaaggttacggaaacgtaacgaccgacttaaactttaatttattgtacgaaggtaaacgtcgttttacggttacgggttacgagtactactacgaagttcggtaggtaagttaggggtacggtacctacgtaccctacgggtcggggaaccgtaaggggaacctaggtacgtacgtacccgtctacccgtacaccggcccctaccgacccggaaccgggtcccacggttaccccggtcccttacccccggcgtacccctaccctacccgtaccgaacggtccgaccgtacccgg

SEQ ID NO: 44122 - DNA, 880 bp, Homo sapiens
  misc_feature: GYAE6OF02JI4HG.31.14.B03.1.454.CMB.1.raw
  modified_base (273)..(273): a, c, t, g, unknown or other
  misc_feature (273)..(273): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatcgcacgtcggggtcccgccgaggcccccagggaccgaacggggactgggaggtggggtggctaagttttaanactaatttgagtagggtaagaaattaaaaaattttacggacaggtaaccttccggtacggaacgggtaccgtacttaccgaaccattaccgtaccgtaacggaaccggtacccccctttacccgaaaccctacgttaaccgcgttacgttaactccctaaccgtaaaccgtagaaaacctcgttacgggtaccggtaacgtaacggttaacggaaacgtacccgtaaccgggtaaccttaaacgtttagtttaacgtttcggtaacgtaacggtaaacggtacgttttaccggttttacgggtacgaaggttctaacgttaacgtacgtttacgggaggttaacgggttacggggggttccggtaccgttaacggtaacccggtccgggttaccgggggtaaccgtaacgggggtaaaccctaacgggtttacgggtccccgttaaacccgggttcccttcccgtaacggtaccggtacccccgttacccggaaacccgtaaccgggacccccgttacggttccccgggttccccgttaccccccgttcgggacccccttaccccgtaccccggttaccgaaccggttcccgaacccttaccccggg

SEQ ID NO: 44123 - DNA, 889 bp, Homo sapiens
  misc_feature: GYAE6OF02GJXCR.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctagaattcactcctcgaggctactagtcggacagtcgcctacgtcggggtcccgaccgaccggccccgagggaccgaaaggggctggggtagggtggggtcggtacttaagttttactaacgttaagtttaggagtagggtaaagttaaaactttaaaaaaacgttttcgacgaacggtaccgttaccggtagggaacgggtacccgtaactttacccgaacctactacccgtaccgaacggtaacccgtaaccccctaaccctaaacccgtaaccttaccgtaccgttacgttaccttaccgtaaccctaaagtacggaaactacggttagggtacgaaacgttaggttaacggaaaccgtaccggtaaccgtaacttaaaccttttagtttaagttacggtacggtaacgtaaacggtttcgtttacgggtttacggtacgtacgtacttaacgtacgttaagtagggttagggtaacggttaggggtaccggtccgtaccgggtaacccggtccggggtaccgggggtaaccgaacgggggtaaccgtcccgttacgggttacccgtacccgttccctccggtacccgaccgttcccgtaacccggaaccggaccgggtccctacggtttcccccgggtcccttcccccgggtaccgaccccttacccccttaaccggtacccgacgtacccggtcccgtaacccgggg

SEQ ID NO: 44124 - DNA, 857 bp, Homo sapiens
  misc_feature: GYAE6OF02HJ4T1.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcgaggccactatggcatgcctacgtcgggtcccgccgaacgggcccccagggaccgaagggtactgggtacggtggggtgctaagtttacactaagtttgagtggaagtaaattaaaaaagttttaccgacaagtacctccggttaggaacgggcccgtattacccgaacctacgttcctaccgaacgtaaccgtacccccttacccgaaaccctacgtaccgtcgttacgttaactaccgtaaaccctaaaagtacgtaaacgtacgttagggtacgtaacgtaaggttacggaaaggtaacccgaaccgggtacttaaacttttagttaacgtttagtacgggtaacgtaaacggtttagtttccgggtttggttacggacgtactaagtaccgttaaagtcggtaggtaacggttacggggtcgtaccgtacgaacccggtaccgggtcggggaacccgggaagggaaacccgtggtaaccggttcccgtaacccgttccgttacccgtaccgtacccggtacccctacccgaaacccgggttaacccggtacccccgtacggtttacccccgggttcccccgtttaaccccccgggcggttaaccccccttacccccggttaccccgttaaccggaacccggtaccccgtacccgttaaccccgggg

SEQ ID NO: 44125 - DNA, 861 bp, Homo sapiens
  misc_feature: GYAE6OF02H1G71.31.14.B03.1.454.CMB.1.raw
  modified_base (274)..(274): a, c, t, g, unknown or other
  misc_feature (274)..(274): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcgaggccactagtggacagtcgcacgtcgggtcccgccgacgggccccagggaccgaagggactggggaggtgggtgactattttanacgtaagtttgagtaggaacgtaaattaaaaaagttttcgactaagtacctccggtaggaacgggtaccgattacccgaacctattcctaccgaagtaccgtaaccccttccaaacctactaccggcttacgtaactcctaaccgtaaaagtcgtaaacctagtacgggtacgaacgttaacggttacggaaacgtaccgaaccgggtacttaaaccgttttattaacgttttcgaacggtaaacggtaaacgtttagtttcccgggttttaagggttaccggtaagtaccgttaacttacgtaacggtttgggtaagggtaggttacgggggttcggtacccgtaacgggtaaccgtacccggggtggggtaacccggtaaaggggtaaccctcccggttacgggtccctaaccccggtttacccgtaccgtaaccgtacccgtccccgtaaccccggaacccgggttaccggggaaccccccgttacggttccccggtttacccccgttaccccccgtacgggtacccccttacccccggttacccgttaacccggaaggtacccccggtaccgttaccccgggg

SEQ ID NO: 44126 - DNA, 807 bp, Homo sapiens
  misc_feature: GYAE6OF02HBTBE.31.14.B03.1.454.CMB.1.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctggagactctcctgtgccatgtctgcgtctgattcatcctcaggccactatggcatcgcncgtcgggtcccgccgaccggccccaggaccaagggctgggacgtgggtcgctaatttanactaattgatggaagtaattaaaaactttcgacaagtacctccggtaggaacggtaccgtattaccgaacctacttccgtacgaacggtaccgtaaccccctttaaccaaccgtaacttaccgaccgttacgttaactcccttaaacgtaaacttacgaacgtaacgttggtaccgaagtagttacggaaacgtaccggaacgtactaaactttacgttttacgttaggacgtaaccgtaaaggtttactttacgggttttacgggtaccggtaacgtcgtaagttaacctaaggttcgggtagggtaaacggtttgggggtacggtaacccttacgggtaacccgtaccgggacgggggtaacccgtaaggggtacctaaccgggttcgggtaacccttcccgttaccttcccgtacctacccgccccgtaccccgaaccgggtacccgggtaccccttacgggtttcccgtcccccgttacccccggacgtcccccgtaccctacccgtacccggtaacccggatccccggtaacccgg

SEQ ID NO: 44127 - DNA, 867 bp, Homo sapiens
  misc_feature: GYAE6OF02FPGPX.31.14.B03.1.454.CMB.1.raw
  modified_base (261)..(261): a, c, t, g, unknown or other
  misc_feature (261)..(261): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctggggggtccctgagactctcctgtgccatgtctgcgtctgaattcatcctcaggcactatggcatgctacgtcggtccgccgacgggccccaggccgaagggctgggaggtgggtcgactatttanactatttgagtggaataaattaaaaagtttcgactagtaccttcggtaggaacgggtaccgtacttaccgaacctagtccgtaccgacgtaaccgtacccccttaccgaaacctacgtaccgtcttacgttactacctaacctaaaactcgaaactagtaggtacgtaacgtaggttaacggaacgtaaccgtaacggtaacttaaacgttttagtttagttacggtaacgtaaccggttaaaacgttacgttttaccgggtttagggttacccggtaacggtacttaacgtaaccggttaagggttgggttaaacggggttaggttaacggggttacggtccccgttaaccgggtacccggtaaccggggttaccggggaaccggtaaacggggttaaccctacgggtttaccgggtacccgttaaccccggttccttacccccgttaggtacccctaccccgttaaccccggaacccggttaaaccggggtccccctttaaaccggtttcccccgggtttaccccgtttcccccccggacgggttacccccctccccggtttaacccgaccccggtaaaccggtccgttacccgttaccccggg

SEQ ID NO: 44128 - DNA, 656 bp, Homo sapiens
  misc_feature: GYAE6OF02FLMU9.31.14.B03.1.454.CMB.1.raw
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagcagtagacgtcacgaccggtgctcgatttagtgtgagtagtttgggctgagctggggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcaagggctgggagtgggtgctatttatactaatttgatggataattaaaaatttcgcagactcgtaggaaggccgattcaccatctccagacgacccttaccaaccatacgctagtactctaccaaatacgaacatggtnactaggtanaagacacggtactaattattagtgtagagtaaagtgtttacggttcggtacgtagtctaattcaagttcggtggtaagtacggggtgcctacggacgtaccggtcggggacgtaacgggaccaacggttccggtccttaacccggttcctacccgttccaacgtcccttacccgaaccggtaacccgggccctaccggtttcccggttcccctttacccccggtacggaccccttaccccgtaccccgttaccgaacggtcccggaccgttaacccgg

SEQ ID NO: 44129 - DNA, 879 bp, Homo sapiens
  misc_feature: GYAE6OF02IBHCM.31.14.B03.1.454.CMB.1.raw
  modified_base (225)..(225): a, c, t, g, unknown or other
  misc_feature (225)..(225): n is a, c, g, or t
  modified_base (762)..(762): a, c, t, g, unknown or other
  misc_feature (762)..(762): n is a, c, g, or t
tcagcagtagacgtcacgaccggtgctcgatttagtgtgagtagttgggctgagcgtggtttccgtcgttgctctttaagaggtgtccagtgtcaggtgcacctggtggaatcgtggggaggcgtggtccggccgtgggggtccctgagactctcctgtcgccatgtctgcgtctagaattcactcctcgaggcactagtcggcagtcgctaccggtcgggtccnccgacggtaccccgagggacgaaagggtcgtggggtaggtggggttacggacttaagttttacaaactaagtttggtaacgtaggggtaaactaaaaagtttaaaaaacgttttcgacgtaagtacccgttaccgggtaggaaacgggtccttacgttacccaccgttaacgtccctacgaacggtacctacccccgttaaccgaaccctaacgttcccggtaattccggttaaccttaccttaaccgaaaacgtacggtaaacgtcgttaagggactaaggtaacgttacgaaacgtaccgtaacggttaaccgttaaacttttaggttaccgttaggtaaccgtaaagggtaaatttacgggtttcgggttttacgggtacgtaaacgtcgtacgtaaaggtagttggttaacggggttacggtaacggttccgggaacctttaccggaccgtaccgggtaacgggaccgttaaaccgggactaccggggtaccgtaccgttaccctacgttaccctaccgtacctacccccggngttaaaccccggacggtacccctacggtttacccccgtcccccgttccggtaccccggtacccccaacccccggtttcccgaaaccggacccgttcccgggaaccccttacccgggg

SEQ ID NO: 44130 - DNA, 632 bp, Homo sapiens
  misc_feature: GYAE6OF02JGCUR.31.14.B03.1.454.CMB.1.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggcactatggcatgcactgggtccgccacggccccagggccaaaggggactgggagtggggtggcgtatttatacaatttgatggagaattaaaaaattttcganagactccgtgaacgggcatcaccntcnccagagaccctccaacatacgctgtatcacctaaatagaanatggtgaactagttagagacacggcaactttattattgtagacgtaaagtctttaggttaggttcgtagtcgtatataagtgtcgggtataggggtgtccgtacgactaccgggtcgggaccgtacggggaactacggtacggtaccgtaccgttccgtcccgtacgaccgtcctacccgaacgtaacgggccctaacgttcccggttccccgttcccccgtagtaccccgtaccccgttccctacccgaaagccgtacccgtaccccggg

SEQ ID NO: 44131 - DNA, 787 bp, Homo sapiens
  misc_feature: GYAE6OF02GDC54.31.14.B03.1.454.CMB.1.raw
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggccactatggcatgcacgtgggtccgccacggccccaggaccgaagggtactgggaggtggggtcgctatttanaacgtaatttgaagtggaagtaaattaaaaaattttcgacaacgtacgtccggtaggaacggtaccgtattacaacctatacctaccagtaccgtaccccgttaccaaccctataccgcttagtaactacctaacctaaagtcgaaactgtaggtacgaactaaggttaagaaacgaccgaacggtaactaaactttaattagtttagtacggaacgtaaagtttacgtttacggttagggttacgacgtactaagttacctaaggttggttaagggtaaggtggggttacggtaccgtaccgtaccgtacccgggtcggggaaccgtaaacgggtaacctaccgggtacggttacccgttaccgtcccgttaccccgtagtaaccccggtcccttaccccgaacccggtaacccggggaccctaaccggtttccccgggttaccccctttaccccggtacccggtacccccttaccccgttacccgaacccgtaaacgtacccggtacccgttaaccccggg

SEQ ID NO: 44132 - DNA, 776 bp, Homo sapiens
  misc_feature: GYAE6OF02HKYRX.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagttgggctgagctgggtttcctcgttgctctttaagaggtgtccagtgtcaggtgcacctggtggaatcgtggggagcgtggtccggcgtgggggtccctgacgactctccgtgtcgccagtgtctgcgtctagattcatcctcgagctactagtggcatcgctacgtcgggtccncgacggcccgaggacgaacgggtacgtgggacggttggggtcgtacttaagttttaactaacgtaagtttcgaagtagggtaataaaagttaaaaacgtttcgacgtacggtactaccgggtacggaaacggtccgttaagttaccctaaccgtacttaccgtaccgtaacgtacccgttaaccccttaccgaaaccgtacgttaacggcgtttacggtaacttacccgtaaactaaacggttacgaaacgttcggttaggtacggtaaacgttgggtaacgaaacgtaccgaacggttaccttaaagtttacgtttgtaacgttacggaaacgttaaacggtttacggtttcggtttcggttaaccggacggacttaacgtacgtaaggttacgtaggtacgtgggtacgtcgtacgaccgtacgtcgggaacgtacggacgtccgtcgtaccgtccgtctcgtacgaccgtcctacccgacggtaccgtccttacggtccgtacccgttccgtccgtaccctacccgacctaccgtacgtaccgtacgtacccgg

SEQ ID NO: 44133 - DNA, 827 bp, Homo sapiens
  misc_feature: GYAE6OF02IFDY9.31.14.B03.1.454.CMB.1.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (322)..(322): a, c, t, g, unknown or other
  misc_feature (322)..(322): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctgaggcactatggcatgcacgtcgggccnccgacggccccaggcgaagggcgtggagtgggngctatttatactaatttgagtaggaagtaattaaaaatttcgacagtactcggtagacggcgtataccactntctaccgagtaccgtaccctacaacctagtacgcttagtatacctaaccaaagtacgaactagtcgtatacgtaaggttaggaaacgacgaacgtacttaactttaagtttaatttacggtacgttaaccggggtaaaagtttacggttttaccggttttcgggtttaacgacggttaacgttacgttaaaccgtaaggttttggggttaaagggttacgggtttaaacgggggttcggttacccgttaccggttaaccggacccggggttacgggggaaacccggtaaacggggtaaccgtaacgggttccccgggttacctaacccccggtttccgtaaccccgtacgtaaccccgacccgtaaccccgaaccccgggtaaacccgggtccccctaaccgggtttcccccggtttccccccgttttaacccccggtcccgggacccccttaccccttacccccggtaacggttaaccccgcccggttacccggtaaccccggg

SEQ ID NO: 44134 - DNA, 808 bp, Homo sapiens
  misc_feature: GYAE6OF02FV1P9.31.14.B03.1.454.CMB.1.raw
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtcccnccagggccccaggcaagggtactggagtgggtggctagttttanactaagttttgaatggagtaattaaaaaaatttttaccggactaaggtactccggttaggaaacgggtccgatttccaccgtattcgtacccaggtaacgacccctttaccaaacccgataccggcttgtattacctcctaaaatacgaaacaattgggtanaaccgtaggttagaaggtaaccaacgggtctaaacctttagttactttaggtagccgtaaaagtacgttttacggttacgggtttcggaacggtactacgttaccgtaaagttggttagggtaacgttacgggggttagggtcccgttagggtaacccctacccgggttcgggggaacccggtaaacgggggaaactaccgggttaccggggttacctaacccgggttccttcccgttacccgaccgtacccccttaccccgaacccggaaaccggggtccccaacggtttacccccgggttaccccgttttaccccccggttcgggtaccccctaccccccgtttcccgaacccccgttaacggacccggtccctaacccccgggg

SEQ ID NO: 44135 - DNA, 796 bp, Homo sapiens
  misc_feature: GYAE6OF02HMN3O.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtccctgagactctcctgtgccatgtctgcgtctgaattcatcctcaggcactagtgcatcgcacgtcggtccnccacggcccaggacgaggacgtgggagtgggtgctagtttacaacgtatttgagtacggtaagtaaaattaaaaacgtttcgacgtacgacgtaccggtaggaacggccgtaacttccacgtactcctaccgacgtaccgtacccttaccaaacctatacgtctacgtactaccgtacctaaagtaacgaactagtacggtacgtaacgtaacggttacgaaacggtaacgtacggtaacttaaacgtttacttacgtttaggtacgtaacgtaaagtttcggtttacggttacgggttacgaacgtcgttaaaagtcgtaaaggttggtacgggttaaacggttacggggtcggtaacccgttccgtaaaccggtaccggggtacggggaacccgtaaacgggtaccgtacggttaccggtacccttacccggtccgttaccgtacccgtaccgtaccctacccggaacccggtacccggggtaccttacccgggtttccggttaccccccgttacccggtccgttccccgtaacccccgtcccgttaaacccggtacggtacccgtaccgtaccccggg

SEQ ID NO: 44136 - DNA, 814 bp, Homo sapiens
  misc_feature: GYAE6OF02F6WSV.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatccctcaggtcactatggcatgcacgtgggtccncctaggccccgaggcgaacgggactgggacgtgggtggctaacgtttataactaagtttgagtacggaagtaaacttaaaaaattttcgacacggtaacctcccggtaggaacgggccctattaccacctaactcctaccgagaccgtacccttaccaacgataccgctagtaactcctaccaaatcgaactagtaggtcgaacgtacgttaggaaacgaccaacggtacctaaagtttacgtttacgtttggtacgtaacgtaaacgggttacttttacggggtttacggtttacggaagttccctaaagttaccgtaaaggttcgggttagggtaaacggttacggggtacggttaccgtacccgggaccgtaccggttaccggggggaaccgttaaccgggaaacccgttacgttaccggggtacccttaaaccccggggtccttacccgggtttaccaccgggttaccccctacccggaaacgggtacccgggtcccctaaggtttaccccgggttcccctttaccccccgggtggtacccccgtaacccccgtttacccgaccgtaaacggtacccggtccctaaccccggg

SEQ ID NO: 44137 - DNA, 789 bp, Homo sapiens
  misc_feature: GYAE6OF02JXQSM.31.14.B03.1.454.CMB.1.raw
  modified_base (190)..(190): a, c, t, g, unknown or other
  misc_feature (190)..(190): n is a, c, g, or t
  modified_base (671)..(671): a, c, t, g, unknown or other
  misc_feature (671)..(671): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgattccatcctnaggcactagtggcatgcacgtcgggtaccgccacggccccaggtcgaaagggtcctgggagtgggtaggctaagtttatactatttggagtgggaataaactttaaaaaacgttttcaccgtaagaccgttccggtaggaacgggtacctagttacccaactactcgacctaggacctaccccgttaaccaaccttagaccgtacgttacgttactacctacaaacgttacgaactacgttcggtaagtaacgttaggttaacgaacgtaaccggtaccgtaacttaaactttagttacgttagtacggaacggttaaagtcgtttagggtttacgtcggtacgtatacgtacgtagtagggtaagttacggttaggggtacgtaccgtaacgtcccgtaccgggttacgggggaccggtaaaggttaacccgtacgttacggtacccgttaaccgttcccgtacccgtaccggttaaccnccccggttaaccaacccggggttaccggaaccccggtttagttccccgggttaccccttaccccggtccggtaacccttcccggaccccttaccgacggttactcccggtaacccggg

SEQ ID NO: 44138 - DNA, 865 bp, Homo sapiens
  misc_feature: GYAE6OF02I1KGM.31.14.B03.1.454.CMB.1.raw
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcctgggggtccctgagactctcctgtgccatgtctgcgtctagaattcatcctcaggcactagtggcatcgcacgttcgggtccnccacggccccaggcgaagggactggaggtgggtgactaatttacgtaactagtttgagtaggaagtaaataaaaaacgtttttacgacaacgtactacccggtaggtaaacgggccgtaacttaccgacctaactccgttaccgaacggaaccgtaaccccctttaacccgaaaccctaacttaacccgcgttacggtacttaaccgtaccgtaaaagtacggaaactacggttgggtacgaacttacggttaggaaaacgaaccggtaacgggtaaccttaaacgtttaacgtttaactttgggtacgtaacggtaaaacgttaacgtttttcggttacgggttttaacggaacggtactaaaccgttaacgtaaacgttacgggttagggttaaacgggttacggggttacggttaccgtaaccgtacctaacccgggttaggggtacccgaaacggggtaaccgtaccgggtttacggtacccgtacccgttccgtaaccccgttagacccgtaccggtaccccgtaaccggtaacccgggtacccctaacccggtttcccgttacccccggttcccccgtaccggttacccctacccccgttacccgttaacccgtaaccggacccgtcccgttaaccccggg

SEQ ID NO: 44139 - DNA, 796 bp, Homo sapiens
  misc_feature: GYAE6OF02FJ3IK.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccgccgacggccccaggcgaagggactgggaggtgggtggactaatttatactaatttgagtaggaagtaaaattaaaaaagttttacgactaagtacttaccggtaggaacgggtccgtaacttaccaacctacgtccgtaccgagaaccgtaccccttaccaaacctacgtaccgtcgttacgtaactacctaaccaaagtacgaaactagttcggtacgaacgtaaggttacgaaacggtaacgtaacggtacttaaacctttaagtttacgttaggtacgtaacgtaaaggttactttcgggtttaggttacgaggtactactacgtaaaggtcggttaagggtaacggttacggggttcgtaccggttaccgaacccggtaccgggtcggggtaaccgtaaacggggtaaccctacgggttccggtacccgttacccgttaccttcccgtaccgtaccgtccccgtacccgaaccggtaaccgggtcccctaacggttccccggttacccccgtttaccccgtacggtaccccttaccccgttaccgacccgtaacggtccgtaccccgtacccggg

SEQ ID NO: 44140 - DNA, 789 bp, Homo sapiens
  misc_feature: GYAE6OF02H3FVC.31.14.B03.1.454.CMB.1.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcgtgggggtccctgagactctcctgtgccatgtctgcgtctgaattcattcctcgaggcacttagtggcagtcgcacgtcgggtcccgacgacggccccgaggacgaagggcgtgggaggtcgggngctatttanactattggagtggtaagtaaattaaaaacgtttcgactacgtaccgttcggtacggaacgggtacgtactacctactacgttcctaccgaggtaccctaaccccttaccgaaacctacgtacgtaccgttagtactaccgtaaccaaagttcgaaacgtaggttcgggactaacgtttaacgtaacggaaacgaccgtaacggtaacttaactttagttacgttagtacgtaacgtaagtacgtttcggttagggtcacgtanacgtacgtaaggtggtacggtaaggttggggtcgtaaccgtccggtaaccgtaacccggggtcggggtaacccggaaacgggtaaccgtccggttacgggtaccccgtacccgttacccgttccgtaaccgtaccgtacccccgtacccggaaccgtaacccgggttccctacccggtttcccgttacccccggttccccgaccggttacccctaccccggttacccttaaccgaaacggtccgtacccgtcccggg

SEQ ID NO: 44141 - DNA, 851 bp, Homo sapiens
  misc_feature: GYAE6OF02H6EEO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcgaggcactagtggactagtcggacacgtcgggtcccgaccgtaacgggccccaaggaccgaaagggtactaggggaggtggggtcgacttaagttttaataaacgttaagtttggaagtaggtaaggtaaaactaaaaaaaactttttacgactaacggtaacttcccggtaaggtaacgggaccgtacgtttaccaaaccgacttcgtacccaacggaaccgtaaccccgtacccaaacctaacgtacgacgttacgtaactacctaacgaaataacgaactagtaggtacgaactacgttaagaacgaccaacggtaaactacgttaaagttagttacgtaagaaccgtaaaagtacgtttacggttacggttaacgtaagtaactaaacgttaagtagggtaaggtacggttaaggggtccggtaagtacccggtaaacgtaccggtaacggggaccggtaaacgggaaccgttacggtaacggtcccgtaaccgtttccgtacccgtacgtaccgtaaccccgtacccgaaccgggaacccggttaaccccggttaacttaccccgggtttaccctacccccccggttaacgggccccccttaacccgtaccccgtttaaccgaaacggtcccgaaccccgtacccggttacccggg

SEQ ID NO: 44142 - DNA, 822 bp, Homo sapiens
  misc_feature: GYAE6OF02JJ6AR.31.14.B03.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
tcagcagtagacgtcacgaccggtgctcgatttagtgtgagtagtttgggcgtgaggctgggttttcctcgttgctcttttaagaggtgtccagtgtcaggtgcactggtggatcgtggggagcgtggtccggccgtgggggtccctgagactcgtccgtgtgccatgtcgtgcgtctagaactcatcctgacggcactagtggcagttcgacctacgttcgggtcccgccgaacggccccaggaccgaagggacgtcgggagttggggtagcttagtttacgactaagtttgagtaggtaanaaagttaaaaagtttcgnaagtacgtcggtaggacgggacctattaccgactagttacnccgaacgtaccgtacctaccgaacctacgtacgtcgtaacgttactaccttaccaaagtcgtaaactaggttacggttacggaactaggttacgaaaccggtaaccgtaacggtactttaacgttacgttttaggacggttacgtaacggtaaagttcgttttacgggttacggtacgtacgtacttacgtagttaaacgtggtacgttaacgggtacgggtttcggacgttaaccgggtaacgacccggggttacggggaacccgtaacgggttaaccgtaacccggtttcggtacccgttaaccgttcccgtttaccttaaccggcccgtaacccggttccccgaacgtaaacccggtccggttaacgtttccccgggtaaccccgtttaccccggtcccggaacccctaccccggtttacccgaaccggttaaccggtacccgtcctaaccccgggg

SEQ ID NO: 44143 - DNA, 773 bp, Homo sapiens
  misc_feature: GYAE6OF02JTXM2.31.14.B03.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (379)..(379): a, c, t, g, unknown or other
  misc_feature (379)..(379): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggctatgctacgtcgggtcccgccgacggaccccaggtacgaacgggactgggagtggggtgctatttaanactaattgatgganaattaaaaactttcgacagctacgtagagggtcataccacattccncacgacgtacccctaccgtaacctataccgctagttactcctaactaaancgaactacttcgggtagaacgtagttaggaactaacggacgtaaccttaactttaagttatttagggtacgtacgggtaaaacgttagtttaccgggttttagggttaccggaacttactaaacgttacgtaacggtttagggttaagggtaaccggttaaggggttcggtacccgtaaacggtacccgtaaccggggttcccggggaaaccgggtaaacggggaacccctttaacgggtacggtaccccggttaacctccccgttacccgtaacgtcccggacccgttcccgaaaccggaacccgggtccctaacggtttcccggttcccccgtcccggtaccggacccccgttacccctaccgtaacccgaaccggttcgaccccttccggg

SEQ ID NO: 44144 - DNA, 885 bp, Homo sapiens
  misc_feature: GYAE6OF02GAKLY.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtcgggtccgccacggccccaggcgaagggctagggagtgggtgctatttatactaatttgagtaggaagtaaattaaaaaacttttcgactaacgaccttccggtaggaacggggacccgtacttaccgaaccgtaacttccgaccgtaacggaccgtaacccccgtttaacccaaacccgtaacgtaacccgtcgttacggtaacttacctaaccgtaaaagttaacgaaaccgtaggttagggtaacgtaaccgttaaggttaacggaaacggtaaccgtaaccggtaaccttaaaccgtttaacgttttaacgtttacggtacggtaaaccgggttaaaaaggtttacggttttaccgggttttacggggtttaaccgtaacggttaccttaaacggttaaccgttaaagggttgggtttaagggttaagggttacgggggttcggttaccggtaccggtaacccgtaccgggttacggggaacccgggtaaacggggaaccgtaccggttcgggtacccgtacccgtttaccctacccggtaccgaccgttaccccgaacccggtaaccggacccggggtccctaccggtttacccggttaccccgttccccccggtaggtacccccgttaccccttacccggaacccggtaacgtacccgtacccgtacccggg

SEQ ID NO: 44145 - DNA, 803 bp, Homo sapiens
  misc_feature: GYAE6OF02FLEAL.31.14.B03.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccncacggccccaggcaagggactggagtggggtgctatttanactaatttgatggaataaactttaaaaaacttttcgactacgtacgtccggtaggaacggggtcctattccaaccgtattctaccgaagaccgtaaccccttaccaaaccctaactaccgtacttacgtaacttacccttaaccgaaaaactacgaaacgtacgttacgggttagtaacctaaggttaacgaaaacggtaaccaaaccggggtacctttaaaaccgttttaagtttaacgtttacgggtacgtaaaccgggtaaaacggttaccggtttttaccgggtttacggggtttaaccggaacggtacctaacggttacctaaaggttggttaagggtacggttagggtcgtaccgtacgaccgtaccgggtcggggaaccgaagggtaacctacggtcggtacctaaccggtctaccttacgacgtcccttaccgacccgtaacgggtaccccaggtttccccggttccccttacccccggtcgtacccccttaaccccgttaccccgtacgaaacccgggtccgtaacccgtaccccggg

SEQ ID NO: 44146 - DNA, 906 bp, Homo sapiens
  misc_feature: GYAE6OF02G278M.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggccgtgggggtccctgagactctcctgtagccatgtctgcgtctagaattcactcctcgaggcactatggacatggcctacgtcgggtcccaccacggccccgtaggaccgaacggggtaccgtgggtaggtgggggttcgtaccttaaagttttaactaacgttaaacgtttggaacttaagggaaagttaaaaacgttaaaaaacgtttcgacgtacgtaccttacccgggtaggaaccgggtacccatttaccgaccgtacgtacctaccggaaacgaccggtacccccttaaccgaacgtaacgttaccggtcttacggttacttaacccggtaaccgtaaaataccgtaaacgacgggttacggttaccgtaaacgtacgggtttaaacggaaacggtaaccgtaaccggtaacctttaaaactttagttttacgtcggttaaacgggaccgtaaaaggtttcgttttaaccggttacgggttaaccggttagtaccgtaagttacgtaaggtttaggttaacggttggtaacggggttcgaccgttaccgtacggtaccgggttacgggggaaccgtaacgggtaaccgtacccgggtttcgaaccgttacccgaccgttaccctacgggtaaccctcccggtaacccggtaacccggtacggttcccccgttaacggttacccccgttaccccccggtttcccggttaacccggaccccttacccccggtacctaaccgggtaacccgtccgacccgttaccccggg

SEQ ID NO: 44147 - DNA, 791 bp, Homo sapiens
  misc_feature: GYAE6OF02GGAS3.31.14.B03.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggctggggggtccctgagactctcctgtgccatgtctgcgtctgaattcatcctcaggctactatggcatgcacgtgggtccnccacggccccaggcaagggctggacgtgggtgctatttanactaattgatggagtaattaaaaatttcgacagtacctcggtagaacgggcctattcgaacctatcctaccgagacgtaaccccttacaaacctagtaccgtcttacgtactaccgtaacctaaagtcgaaacgtagtcgggtacgaacgtaggtttaacgaacgaaccgtaaccggtaacttaaacgtttattaagttggtacggtacggtaaagtcgttttcggttacggtacgtagtacctaattaccggtaagttcgggtaagggtaacgttaggggttccggtacctaacgggtaccgttaccgggtacgggggtaccgtaacggggtaaaccctcgggtttccgggtaaccctttaacccgggtcctttaccccggacgttaacccggtaccccgttaccggaaacccgggtacccgggtaaccccgtaccggtttacccgggttaccccgtttacccccggagggtaaccccctttaccccggttaccccttaaacccggacggttaacccgccccggtttaaccccggg

SEQ ID NO: 44148 - DNA, 975 bp, Homo sapiens
  misc_feature: GYAE6OF02IFXU7.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtgggggtccctgagactctcctgtcgccatgtctgctctgaattcatcctcaggcactatggcatgctacgtcgggtcccgccacggccccaggacgaagggacgtgggaggtggggtggtacctattttataacgtaatttgaagtgggtaaacgtaaattaaaaaaacgtttttaccgacgtaacggacccttaccggtaggaacggggacccgtaactttaacccaacccgtaacttaccgtaccccgaaaggtaaacccggttaaccccccttaaccccgtaaaaccccgtaacgttaaacccgggtccgtttaacgttaacgttaccccgttaacctaaaaaacgttaaccggaaaacgttaaccggtttaacgggtaacggtaaccggttaaacgggtttacgggaaaaaccggtaaaccccgggtaaaccggaacccggttttaaaaaccctttttaaacgttttaagttttacggttaaaggggttaaaacccggtaaaaagggttttaaccggttttaccggggtttttaggggtacccgtaacgggttaaccgttaacgttaaacccttaagggtttacggtacggggtttaaacggttacggggggttacgggtaccggttaacccggtaacccggttaacccgggggttaccggggggaaacccggttaaacggggacgttaaaccggttcccgggtaccgttaaccccggttcctacccgtacccgtacccgtccctaaccggaaccgtaccggccccgtacgttccccggttaccctccccgtacggcccttacccgtaccctacgaacgccgtcgtacccgg

SEQ ID NO: 44149 - DNA, 720 bp, Homo sapiens
  misc_feature: GYAE6OF02G2CL0.31.14.B03.1.454.CMB.1.raw
  modified_base (163)..(163): a, c, t, g, unknown or other
  misc_feature (163)..(163): n is a, c, g, or t
  modified_base (388)..(388): a, c, t, g, unknown or other
  misc_feature (388)..(388): n is a, c, g, or t
  modified_base (609)..(609): a, c, t, g, unknown or other
  misc_feature (609)..(609): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcggtggtccggcctggggggtccctgagactctcctgtnaccgatgtctgcgtctagaattcactccccagccactagtggcatgcacgtgggtacccgccaccggccccgaggccgaaggtctgggacgtgggtgctatttaacgtacgtaatttgagtaggtaagtaaaacttaaaaaattttacgactaacgtacgttccgtacgggacggtaccgtattacctaacgactctacgacgtaactaccccgtacctaaaccncttaactccgtagtacctactaaccaaactacgtaactagtcggaacgtacgttaacggtagaaacgacgtacggtaactaactttaattagtttgaccgtaaggtaaattaaggtttcgtttaccggtagtacgtacacttagtataggtggtaagtggtacggtcttaccgcgtaccgttcggggaaccgacgggtaactacgtctacggaccccgttntccacgtaccctacgaaccgtaccgaaccggtccgaaccggttccccggttcctcccccgtcggacccctacccttaccgaacccgtagaccgttacccgcggttaaccgg

SEQ ID NO: 44150 - DNA, 724 bp, Homo sapiens
  misc_feature: GYAE6OF02JAVA4.31.14.B03.1.454.CMB.1.raw
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
  modified_base (391)..(391): a, c, t, g, unknown or other
  misc_feature (391)..(391): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgctacgtgggtcccnccacggccccagggcaagggctgggagtgggtgctatttanactattgataggataattaaaaatttcgacgacgtactccgtaggaacggccgtacttcacctntcctccaggtaccgtaccccttaccaaccacgtacgcttagtactctaaccaatacgaatacgtggtanaacgtagtagaacgaccgaacgtactaacgttatttacgttagtacgaacgtaaagttacgtttcggttagggtactagtactaacgttacgtaagttacgggtaggtaagttacggggtcgtaccgtaccggaacctcccggggtaacgggtacccggtaaagggtaaccgtccgttacgggtacccgtaccgttccgtacccgttcgaaccgttccccgtacccgaaccggtaaccgggtcccctaaggtttccccgtacccccgtttccccggtaccggtccctaccccgttaccgtaacccggaacggtacccgtacccgttacccggg

SEQ ID NO: 44151 - DNA, 766 bp, Homo sapiens
  misc_feature: GYAE6OF02HKCFH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgccacctggtggaatcgtgggggaggcgtggtccggccgtgggggtccctgagactctcctgtgccatgtctgcgtctagaattcatcctacgaggcactgtgcatgcacggtcggtccgaccacggccccagggtacgaacgggtctgggtaggtcgggtcggacttaactttataactaaagttttgagtaggaacgtaaaattaaaaacttttaccgactaagaccttaccggaggtaacgggccgtacttacaacctactcctacgagaaccgtacccccttaacaaacctacgtaccgtcgtaagttactacctaaccgaaaatcgaaacgtagtcgggtacacgtagtaagaacgaccgacgtacctaatttaagtcttgacgacgtaaagttgtttacgggttggtaacgagtctaagtataacgttgggacggttaaggtcggggattcccgaacgtaccggtacgtaccgggggaccgaaagggtaacctacggttaccgtacccgttaccgtcccgttaccgccgtaacggccccgttaaccccgaaccgggtaacccggtaaccccttacggttacccggttccccccctttaacccggcggtaaccccttaccccctccggttaaccccgaaagggccctaccgtaaccccggg

SEQ ID NO: 44152 - DNA, 791 bp, Homo sapiens
  misc_feature: GYAE6OF02JJO5R.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctcaggccactagtggcatcgccacgtcggggtcccgccacggcccccaggaccgaacgggactgggaggtgggtcggctaatttactactaagtttgagtggaagtaaattaaaaaattttacgactagtacctccggtaggaacgggcccgtacttaccaaccgtatccttaccgacggtaccgaccccctttacccgaaccctataccgtacttcgtacttaccctaaccgaaactagaaactacggttaggtacgtaaccgtaggttaggaaacgtacgacggtaacctaacgtttatttagttacgtaggtaaccgaaaggttacgtttccgggtttagggttacgtacgtactaacgttacgtaaggtggtagggttaagtagggggtacggcccttaacgggaccctaaccgggcgggggaaccgtaacggggtaacctacggttccggtaccgttaaccccgttctacccgtccggtaccgtcccccgttacccgaaccggaacccgggccccttaggtccccggtttaccccgttcccgttaccgtacccctaccccgttaccccgtaccgaaaccggtccgtaccccgttacccggg

SEQ ID NO: 44153 - DNA, 915 bp, Homo sapiens
  misc_feature: GYAE6OF02FYNR2.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatggcatgcacgtcgggtccgccacggccccaggcaagggctggagtgggtggctatttatactaatttgagtaggagtaagttaaaaaaacttttacggacctaacgtaaccttacccgggtagggaaacggggtccccggtactttacccgaaccccaattcctaccgaacggtaacggtaccccccttacccaaacccaacgttaacccggcgttagttaactcctaacctaaaaacttacggaaaactaagttacgggttagaaccgtaaggtttaaggaaacgaacgtaaccggaacttaaaaccgttttaacttttaagtttcggtaacggtaaccggtaaaaacggttaacgttttaccggggttttgggtttaccggtaacgtactaacgttaacgtaaacgtagggtttacggggtaaaggttacgggggttcgggtaccttaccgggtaacccgtaacccgggttacgggggggaaccccgtaaacgggggaaacccggtaaccggttacgggttacccgttaaccccgggttaccgttaccccgttaccgaacccggtaccccgttacccccgaaacccgggtaaccccggggtaccccgtaacccggtttaccccgggttacccccgtttcccccccgtaccgggtacccccttacccccggttacccctaacccggtaaccgtaccggacccttaacccccgggg

SEQ ID NO: 44154 - DNA, 796 bp, Homo sapiens
  misc_feature: GYAE6OF02ISV0U.31.14.B03.1.454.CMB.1.raw
  modified_base (178)..(178): a, c, t, g, unknown or other
  misc_feature (178)..(178): n is a, c, g, or t
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccgggccgtggggggtccctgagactctcctgtgccatgtctgcgtntagattcatcctcaggcactatggcatcgcacgtcgggccnccaggccccaggcgaagggctgggagtgggtnctatttatacgtatttgagtaggaagtaaattaaaaactttacgcaagtaccgtcgaggaacggccgtattccactactcgtaccacgtaccaccttaccaaactactacgtacttagtactactaccaaaatcgtaaacgtagttacgggtacgtacgtaacggttagaaaccgtaccgacgtaacttaaacttttacgttagttacggtaaggtaacgtaaagttacggttttacggtttcgggttacgacgtacgttaaatacgttaaggttggggtacgggttacgtttaacgggggtccggttaacctccgggtaaaccgtccgggttaacggggccggtaaacgggaccgttaggttaaccggtacccgttaccgttaccggttcccgtaccgacccgtacccgacccgaaaccccgggtaccggtcccgttaacccggggtttaccccgttccccccttacccccgggttccctaacccccgttcccccggtttaacccgaaccccggttaacggaccccgttcccgtaaccccgggg

SEQ ID NO: 44155 - DNA, 751 bp, Homo sapiens
  misc_feature: GYAE6OF02GIFF1.31.14.B03.1.454.CMB.1.raw
  modified_base (261)..(261): a, c, t, g, unknown or other
  misc_feature (261)..(261): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtccctgagactctcctgtgccatgtctgcgtctgaattcatccctcaggcactatggcatgcacgtgggtcccgccacggccccagggccgaagggactgggagtgggtgctattanactaatttgatggaagtaaattaaaaatttcgacaacgtacgtaccggtaggaacgggtccgtacttcacctaattcccgtaccgacgaaccgtacccccttaccaaacctaacgtaccgtcttacgttactaccctacctaaagtacaactaggttggtanaaccgtgttacgaaacgtaccgtaacggacttaactttaagtttaagtgtagaacgtaaacgttacgtttcggttacggttacgagtacctaagttaccgtaaggtcggtaggtaagttacggggtcgtaccgtcggtaaccgtccgggtacggggacccgaacgggtacctaacgtccggtacccgtaccgttcctccgttcaccgtccccttacgaacccggtaaccgggtcccctacggtttccccggttcccccgtttacccggcccggtaccccttaacccccgtccccgtaaccgtaccgacccgtaccccgttaacccggg

SEQ ID NO: 44156 - DNA, 750 bp, Homo sapiens
  misc_feature: GYAE6OF02HO89T.31.14.B03.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtcccncacggccccaggacaagggtctggagtgggtcgctaagtttanactaatttgagtggaagtaaattaaaaatttacgcaagtaccgtaccggtaggaacggccgtaattccgacctattcctaccaggacctaccccttaccaaacctacgtacgctagtacttacctaactaaagtnaacgtnttgggacgtacgaagttacgaaacggtaacctacggtacttaactttattaaggttcggttacgaacgttaaaggtacggttttaccgggtttaagggttacgaaacgtcctaagttactaaaggttcgggttaaggtgggttaacgggtcggtaccgtcgtaaccgcccggttagggggaacccgacgggtaacgtaccgttcggtaccccgtaccgttccgtcccgtacgaccgtaccccgtcccgaaaccggtacccgggtcccctacggttaccgttcccccgttaccccgtaccggaccccttacccgtccccgttaaccgaaccggtacctccccgttaaccgg

SEQ ID NO: 44157 - DNA, 794 bp, Homo sapiens
  misc_feature: GYAE6OF02GD8VL.31.14.B03.1.454.CMB.1.raw
  modified_base (263)..(263): a, c, t, g, unknown or other
  misc_feature (263)..(263): n is a, c, g, or t
tcagcagtagacgtcacgaccggtgctcgatttagtgtgagtagtttgggctgagctgggttttcctcgttgctcttttaagaggtgtccagtgtcaggtgcactggtggaatctggggagcgtggtccggctggggggtccctgagactctcctgtgccatgtctgcgtctagaattcatccctcaggcactatggcatgcacgtcgggtcccgacctacggccccaggaccgtaagggctgggagtgggtgactagtttanactagtttgataggaagtaaattaaaaaagtttccgacaagtaccgttccggtagggaacgggtacccgtattccgaacctattcctaccgagaccgtaccccgttaaccaacctacgtaccgtcgttacgtaacttccgaaaccctaaagtacgaaacctaggttagggtacgaacgtagggttacgaaacggtaccgtaacggtaaccttaactttaagtttacgttagtacggaacgtaaaaggtttctttagggtttcgggttacaacgtcttaatacgtaaggtggtaggtaagggtcgggttcgtacctacgggtacctaccggggtggggacccgtaacggggtacctacgggtcggtaccctacccggggtttaactccccgtagtaccccgtcccgtacccgtaaccggtaccccggggtcccttaacggttcccccgggttccccttacccccgggacggttacccctacccccgtcccggttaaacccgaacccggtaccgtaccccggttaccccgggg

SEQ ID NO: 44158 - DNA, 757 bp, Homo sapiens
  misc_feature: GYAE6OF02JGW71.31.14.B03.1.454.CMB.1.raw
  modified_base (219)..(219): a, c, t, g, unknown or other
  misc_feature (219)..(219): n is a, c, g, or t
  modified_base (364)..(364): a, c, t, g, unknown or other
  misc_feature (364)..(364): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcgaggctactatggcatgctacgtcgggtccnccgacggccccgaggctaaagggctggaggttcgggtgacgtaatttagtaactaagtttgagttaggaactaaatttaaaaaacgttttcgaacgtaagtacccgtaccggttaaggaacgggtccgtaacgtccgtaaccgtntacccgtaccgaagtaacccgttaccccgttaccaaaccgttagtaacccgtcttaggttaactacccgtaacgtaaaacgtacgaaaactcggtttaggtaacggtaacctaggttaaacggaacgtaaccgtaacggacttaacgtttaagttgtacgtaggtaaccgtaaagttacgttacggtttcggtaacggatcgtataacgtaggttggtacgttaggtacggttcggactccgaaaggtcccggttacgggccggtaaaggacctacggtacgtcccgtacgtcctccaacgtcgaccctacccgacgtaaccggccttaccggttccgtccccgtccgtcgcccgttaaccctccctaacgaacgttaccgccgttaacccgg

SEQ ID NO: 44159 - DNA, 892 bp, Homo sapiens
  misc_feature: GYAE6OF02HXWWG.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtcccggcctggggggtccctgagactctcctgtgccatgtctgcgtctgaattcatcctcaggcactagtgcatgctcgtcgggtccgaccgacggccccgaggacgaaggcgtggtacggtgggtgacttagtttataacgtaagttgtacgtaggtaaagtaaaacttaaaaaacgttttaccgacgtaacgtaacccgtccggttaagggaaacggggtcccgtaagttaccctaaccctagttccctacccgtaaggaacccgttaacccccttaacccccaaaactaccgttaaccggtacttaccggttaacttaccctaaacccgtaaaagttaacggaaaccgtaggtttaacgggtcggaaaccgtttaagggttaaccggaaaacggaacccggtaaaccggtaaccttaaaaccgttttaagtttaacggtttaggtaacggaaacgggttaaaacgttacggttttacccggggttttaggggttccgtaaacggtccttaagtaactaacggttacgggttaggaaacggtttaggggtcgtacgtaaccggtaccgtacccgggttacggggaaccgtaacggggaaccttaccggtaggttacccgacccgttcccgtacccgttaccgacccgttaccctacccgaaacccggaacccgcccggttaccggttacccggttccccttacccccgtcggtaccccttaccccgtacccttacccggaaggcccgtaccctacccggg

SEQ ID NO: 44160 - DNA, 820 bp, Homo sapiens
  misc_feature: GYAE6OF02JX77Z.31.14.B03.1.454.CMB.1.raw
  modified_base (679)..(679): a, c, t, g, unknown or other
  misc_feature (679)..(679): n is a, c, g, or t
tcagcagtagacgtcacgaccggtgctcgatttagtgtgagtagtttgggctggagctgggttttcctcgttgctcttttaagaggtgtccagtgtcaggtgcacctggtggaatcgtggggagcgtggtccgggcctgggggtccctgagactctcctgtgccatgtctgcgtctaggaacttcgatccctgacggcaactagtggacagtgcctcgtcggggtccccaccgaacggcccccgaaggtaccggtaaagggggtaccttgggggaaggggttcggggttacgggtaccgttaaatttttaacgtaaacccgttaaagtttttagggaaggttaagggtaaaggtaaaaacttttaaaaaaaacgtttttccgaacgtaacggtaacccgttccggtaacgggaacgggtacccgtaactttccgaacccttaagttccctaaccgaaccggtaaccgtaacccccttaccgaaaccgtagtacccgtactcgttaacctccttaaccgtaaacgtcgtaaacgtacggttaggtacgtaactaagggttaacaaacggtaaccgtaacggttacctaaagtttaacgttagttaccgttagaacggttaaagttcgtttacggtaggtacgacgattacgtactaagtcgtggtaagtcggagtaccgngacgtacggtgggaacgtaggactacggtcggtacctaccgtctaccgtaccgagtcccaccgtacgacccggccgttacgtccggtacccctccgcggtacccctacccggaccttccgaacgttccgacccgtaaccgg

SEQ ID NO: 44161 - DNA, 764 bp, Homo sapiens
  misc_feature: GYAE6OF02F9802.31.14.B03.1.454.CMB.1.raw
  modified_base (485)..(485): a, c, t, g, unknown or other
  misc_feature (485)..(485): n is a, c, g, or t
  modified_base (596)..(596): a, c, t, g, unknown or other
  misc_feature (596)..(596): n is a, c, g, or t
  modified_base (658)..(658): a, c, t, g, unknown or other
  misc_feature (658)..(658): n is a, c, g, or t
  modified_base (691)..(691): a, c, t, g, unknown or other
  misc_feature (691)..(691): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtcccggccgtggggggtccctgagactctcctgtcgccatgtctgcgtctagaattcagtcctcgaggctaactgtcggccagtcgcctacgtcggggtcccaccgaccggccccaggtaccgaaacgggcctgggcggtgggtcgtacttaagtttacactaagtttgagtaggtaagtaaactttaaaaacgtttccgacgtacgtacccgttacccggtaaggaaccggggtcctaacgttacccgaacctaagtcctaccgaacggtaccgtaaccccctttaccaaacctacgtaaccgtcttagtaacctaccgtaaccaaagtacaacgtagtcggtacgacttaggtanaaccggactaacggtacctaacgtttagttacgttagacggtaacgtaaagttgttttacggttacggttaaccgagtcctaagttccaggtttcggaggtagtacgggtntaccctcgaccgtccggtaggggaccaagggtacctacgtcggtaaccgtccgccttaccgnacccgtaccctacccgaaccggtacgtaacccnggttcccgtaccccctttccccggaacgttccccctacccgttccgaacccgtagggaccctccctacccggg

SEQ ID NO: 44162 - DNA, 720 bp, Homo sapiens
  misc_feature: GYAE6OF02H0TCZ.31.14.B03.1.454.CMB.1.raw
  modified_base (147)..(147): a, c, t, g, unknown or other
  misc_feature (147)..(147): n is a, c, g, or t
  modified_base (218)..(218): a, c, t, g, unknown or other
  misc_feature (218)..(218): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggctgggggtcctgngactctcctgtgccatgtctgcgtctgaattcactccctcgaggcactagtggacatgcacgtgggtcccnccgacggcccgaggacgaagggactgggaggtgggtgactatttactaacgtatttggagtaggaagtaaattaaaaacgtttcgacgtacgtaccgtccggtaggaacgggtccgtaacgttaccacctacgtccgtaccgaacggaccttacccctacctaacctacgtaccgtacttagtactacctaacaacgtacaacgtagtagtacgtatacggttagaacgtacacggtaactaacgtttattatacggtagtaacggtaagtacggttttacgggtacggtttacggactacgtaatacgtaagtacggttagtaacggttagggtcggtacctacggtaccgacgggttacgggacggtaacggacgtacgtccgtccgtacgttcctaccgtccgtacctcccgaccgtaccggacggtacccgtaccgtaccgtccccgttaccgccggtaccctcccgtacccaaccgtaccggacgtcccgtaccggg

SEQ ID NO: 44163 - DNA, 729 bp, Homo sapiens
  misc_feature: GYAE6OF02IFOE5.31.14.B03.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggccgtgggggtccctgagactctcctgtgccatgtctgcgtctgaattcatcctcaggcactatggcatgcacgtgggtccnccgacggccccaggcaagggctggaggtgggtgctatttanactaatttgagtaggaagtaaattaaaaaagttttacgacaacgtaccgttaccgtaggaacgggccgtaacgttccaacctacgttcctaccgaacggaccggtaacccccttacccgaacctacgtaccgtcgtacgtaacttccgttaaccaaaagtacgtaaacgtacgttagggtacgaccgtaaggttagaaacggaaccgtaaccgaaccgttaaactttaactttagttacgtacggtaaccgtaaaagttacgtttcggtttacggttacgaagtactaataccgtaagtggtacggtagtagggttcgtacgtaccgaccgtaccggtaggggaccgaagggtacacgttcggtaccaccggttcctccgtacaccgtcctacccgaacccgacgggtccctaccgtccggttccccttacccggtccgtccctcccgtacccgtacgacgtaccgcctaccgg

SEQ ID NO: 44164 - DNA, 724 bp, Homo sapiens
  misc_feature: GYAE6OF02IAKQ5.31.14.B03.1.454.CMB.1.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (515)..(515): a, c, t, g, unknown or other
  misc_feature (515)..(515): n is a, c, g, or t
  modified_base (689)..(689): a, c, t, g, unknown or other
  misc_feature (689)..(689): n is a, c, g, or t
  modified_base (717)..(717): a, c, t, g, unknown or other
  misc_feature (717)..(717): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtcngcgtctgaattcatcctnaggcactatggcatggcacgtgggtcccgccacggcccccagggcaaggggactgggaggtggggtggctaatttatacgtaattttggagtaggaaagtaaaattaaaaaaaacgttttcgacaagtaccgttccggtggtaaacgggggaccctatttacccaaccgtacttccgtacccgaagtaccgtaacccccttacccaaaccgaactaaccggcttacgtaattccctaacctaaaagtagaaaccctagttcgggtagaacctaggttaacggaaacgaccgaacggtaacttaactttaacgtttattcggttanaacggtaaagttagttttacgggtttcgggtttacgagtacacgtataaaggttcggtagggttacgtaggggtcggtacctacggaccgacgggtcgggaccgaagggacctaggtcgtccaccttgcctcagccctacaccggtacggcctacggttccgtcccttccccgnggccctaccccgacctaccgaacggtcncccgtcg

SEQ ID NO: 44165 - DNA, 661 bp, Homo sapiens
  misc_feature: GYAE6OF02HK7XC.31.14.B03.1.454.CMB.1.raw
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccnccaggccccaggcaagggactggagtgggtggcatttatacaatttgatggagaattaaaaattttcgacagactcgtgaaggccgtattcaccatctccacgacgacccttaccaaccactacgctgtactctaccaaatcgaacatggtcgaactagttagaagacacggactaacttattacttgtaggacgtaaagtacgtttcggttggttacgagtactaatacctaagtcggtaggtagttaggggttcggctcggtaaccgtaccgtcgggggaccgacggggaaccacgttcgggtacctacccgttctcccgtacgacggtccctaccgaacccgaacggggtcccctaacggtttcccggtaccccgtttcccccgtcgggtaccccttacccccgttacccgttacccgaaccggaccgtacccgtaaccccgg

SEQ ID NO: 44166 - DNA, 806 bp, Homo sapiens
  misc_feature: GYAE6OF02G9QTL.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctgggggtccctgagactctcctgtgccatgtctgcgtctgaattcatcctcaggcactatggcagtcgcacgtgggtcccgccacggccccaggcgaagggactgggagtgggtgctatttanactatttgagtaggaagtaaatttaaaaacgttttcgacgtaagtaccgttaccggtagggaaacgggtccttaagtttaccaaccctaacttccctaccgaacggtaccgtaaccccctttacccaaaacctagttaaccgcttacgttaactacccgtaactaaagtacgaaacgtagtggtacgactaaggtagaacgaaccgtaacggtacttaaactttagttacgttaggtacgtaacggtaaacgttcggtttttcggttagggttaccgaagtacgtaactacgtaaagtgggttacgggtaaggtttagggggttccggtaccgtacgggtaacccgtaccgggttacggggaccggtaaacggggaacctacggttccgtaacccgttacccgttacgtccccgtaccgtacccgtccccgtaccgaaaccccgggtaccggtaaccccgttacgttcccgggttaacccccttcccccggtacggttcccctacccgtaccccgtaccgtaaccggccgttacccgtaccccggg

SEQ ID NO: 44167 - DNA, 715 bp, Homo sapiens
  misc_feature: GYAE6OF02FTQ9K.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactatggcatgcacgtgggtccnccaggccccaggcaagggactggagtgggtgcatttanactaatttgataggagaataaaaattttacgacagactcgtgaaggccgatcgaccatctaccagacgacccttaccgaaccataccgctgtactctaccaaatcgaacatacggtgaacctagttacgaaacgacaaccggtactaaactttacttaatttacggtacgtaggtaaaagttactttaccggttttacggtttaccggaagtaccgtaattacggtaaactggttaggtaaagttacggggttcggtaaccgttcgaaccgttaacccggtcgggggtaacccagggggtaacctacggttaccggttaccaaccccggttccttcccgttacgaaccgtcccctacccgtaacccggaagggtccccaacggttacccggtttccccgttacccccgttacgggccccttacccccgttaccgtaccgaaaccggtcgaccccttacccgg

SEQ ID NO: 44168 - DNA, 855 bp, Homo sapiens
  misc_feature: GYAE6OF02FLCVN.31.14.B03.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctggcgtctgaattcatcctcaggcactatggcatgcacgtgggtccnccacggaccccaggcgaaagggctggaggtgggtgcgtatttatactaatttgagtaggaagtaaattaaaaaagtttcgactaagtaccgttaccgtaggaacggggtccctacttaccgacctacttcccgtaccgacgaaccggtaccccctttaaccgaaaccctaagttaccggacctttcggtaacttaccgtaacctaaaagtaccgtaaactaggtacggttacgtaacgtaacgggtttacggaaacgaaccgtaaccgggtaacctttaaacgtttattttagttacggtacgtaaccggtaaaagtttacgtttcgggttttaacgggttacccgtaacggtaccttaacgttaccgaaaggtttggttaacggggttaggttaacgggggtcgtacccggtacggtaacccgtacccgggttcggggaaccccgaaagggggtaccttaccgggttacggggttacccacccggtttcgtacccgtccgacccgttaccccgtaccccgaaccgggtaacccgggtccctaaccggttcccggttaccccgtttacccccggccggttacccccttacccccggttaccgttaccccgaaagggtacccttcccgttaaccccgggg

SEQ ID NO: 44169 - DNA, 726 bp, Homo sapiens
  misc_feature: GYAE6OF02GGX82.31.14.B03.1.454.CMB.1.raw
  modified_base (623)..(623): a, c, t, g, unknown or other
  misc_feature (623)..(623): n is a, c, g, or t
  modified_base (630)..(630): a, c, t, g, unknown or other
  misc_feature (630)..(630): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcaggcactatggcatgcacgtcgggtccgccacggcccaggcaagggctggaggtgggtgctattatactaagtttgagtaggaataaagttaaaaaattttacgactaagtaacctccggtaggaacgggccgtattacccgacctatcctaccgaaggtaccgtacccctttacccaaacctataaccgcttacggtactaccgtaacctaaagtacgtaaacagttggtagaaccgtagttagaaacggaccgtaacggacttaaacgtttacgttagtttacggtagtaacggtaaacgttcgttttccgggtttagggttacacgtactacttactaaggttggtaggtaacggttacgggttgcccgttacgaaccgtaccggtcggggtaaccaacggggtacctacggtcggtacctaccgtcctacnccgtacnccctacgaccggaaccggtccctacggtcccggttccccgttccccgtggtacccctacccttacccgaccggtacgtaccgcccgttaacccggg

SEQ ID NO: 44170 - DNA, 813 bp, Homo sapiens
  misc_feature: GYAE6OF02JZ69A.31.14.B03.1.454.CMB.1.raw
  modified_base (187)..(187): a, c, t, g, unknown or other
  misc_feature (187)..(187): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgattcatccnaggcatatggcatgcagtcgggtccgccacgggccccaggcgaagggctgggaggtgggtacgctaatttanactaagtttcgataggtaataaaactttaaaaagttttcgacctaacggtaccgttccggtaaggtaacggggtcctaagtttcccgaaccgtaatttccaaccgtaaggtaacccggtacccccttttaaccgaaaccgtacttaaacgccttaaggtaccttacccgtaacgtaaaactacggtaaacgtatttacgggggtacgtaacgtaacggtttaacgaaacggtaaccctaagggttaaccttaaacgttttaacttaagttcgggtaaaccgtaaggttaaacgtcggttttaagttaccggggtactacggtacttaacgtaaccgaagttacgggtagggttacttaggggtccggtaaccttacgaccggtaaccgtggggaaacctaacgggtaactccgttaacggggtccttaacccgggtctaaccggtcgtaaccgttcccaaccggtaccgaccgggtaacccgtccgtttaaccgttcccctaccccggttacggccctaaccccggtcaaccggttacgaccgtcgtaacccgg

SEQ ID NO: 44171 - DNA, 950 bp, Homo sapiens
  misc_feature: GYAE6OF02I2DOO.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcgtgggggtccctgagactctcctgtcgccatgtctgcgtctagaattcactcctcgaggaccactagtggccagttcgcctacggtccgggtcccgccgaaccggcccccgaaggacgaaacgggtacgtggggtagggttcggggtcgtacttaattttaactacgttaagttttaggacgttaggaaaacgttaaaaagttttaaaaaacgtttaccggaacgtaacgtaacccggttaccggtaagggaaccggtaccgttaccttacccgaacccttactaccctaaccgtaacggtaaccccgtaacccccttaacccaaacccgtaaccgtacgtacccgttacgttaaccttaccgtaaaaccgtaaagtaccgtaaaccgttagttcgggtaaacgtacgtaacggtttaacggaaacggtaacccgtaacggtaacctttaaacgttttaacgttagtttagtacggtaaaccgttaaagtttaccggtttacgggtttacggtacgtacgttaacgtaaccgttagtaaggttaacgggtagggttaacgggttacgggttcggtaaacccgtccggtaaccgtaccggggttaccggggaaaccggtaaacggttaccgtaccggttacggtaccggtacccgttccgttacccgtacccgtaacgttccccgaaacccggtaaccggaacccggtaccccgttaaccgggtttccccgttcccccggtttaaccccggcccggtttaccccctaccccgttaacccggtaccgtaaaccccgttccggtaccccgtaacccggg

SEQ ID NO: 44172 - DNA, 836 bp, Homo sapiens
  misc_feature: GYAE6OF02I3AMZ.31.14.B03.1.454.CMB.1.raw
  modified_base (174)..(174): a, c, t, g, unknown or other
  misc_feature (174)..(174): n is a, c, g, or t
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggccgtgggggtccctgagactctctgtgccatgtctgcgtntagtaattcgactcctcgacggctacgtagtcggctaagtgcccgtacggtccggggacccgaccgacccgggaccccgagggaccggaaaagggggtccgtagggtaggggtcgggtgaccttaagtttaacgtaaacttaagtttcgtaggtaggtaaagtaaaaacgtttaaaaacttttcgaccgtaagtacccgttacggtaagggaacggtacctacgttaccgtaccacttccaccgtaacggacccgttaaccccgtaccaacgtaaccgtaccgtcgttaacgtacttaacccgaccgtaaagtacggtaattagggtacgttaggaacgtttaagacggaaagtaccgtaacgtaacttaagtttagttacggttagaacggtaacgttaacgtaggtttcgttaggtacgtaagacttaacgaacgttaggttgtagggttaaggttacgggtccggttacgaactaccggtacccggtacggggaacgtaaacgggtactacgggtaccgtacccgttacgtacccgttccgaccgttaaccggcccttaaccgggaacccgttaccgggacccttaccggttcccggtaaccccgtttccggacgttacccccgccttaccctaacggaccgtaccggaccctaccggg

SEQ ID NO: 44173 - DNA, 302 bp, Homo sapiens
  misc_feature: GYAE6OF02G1OCK.31.14.B03.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (282)..(302): a, c, t, g, unknown or other
  misc_feature (282)..(302): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtgggggagcgtggtccggccgtgggggtccctgagactctcctgtgccatgtctgcgtctgaattcatcctcaggtcacttanggacatgctacgtgggtcccncgaccggccccagggaccgaaagggtcgtgggtaggtggggtggactaattttacaacttaannnnnnnnnnnnnnnnnnnnn

SEQ ID NO: 44174 - DNA, 678 bp, Homo sapiens
  misc_feature: GYAE6OF02IDZ5S.31.14.B03.1.454.CMB.1.raw
  modified_base (187)..(187): a, c, t, g, unknown or other
  misc_feature (187)..(187): n is a, c, g, or t
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgcacgtcggggtcccnccacggcccccagggccaagggactgggagtgggtggctatttanactaatttgatggagtaattaaaaaacttttacgactaagacctaccggtaggaacgggcctattaccgaacccattccgtaccaaggtacgtaaccccgttacccaaccaacttaccgccttagttactacctaccaaatgaaacctgtaggtgactaaggttagaagaccgtacgacttaactttattatttcgtagacgtaaaggtacttttcggttggtttacgagtctaattacaagttggtaggtaagttaggggtcgtctacgacgaccgtggggaccgaggacgtacgttcgtacgaccgttctcctacgcgaccctccgaacccggacggccctaacgttccggttaccccttccccggtaccggaccctaccccgttccctacccaacggtccgacccgtacccgg

SEQ ID NO: 44175 - DNA, 887 bp, Homo sapiens
  misc_feature: GYAE6OF02FRZJ0.31.14.B03.1.454.CMB.1.raw
  modified_base (195)..(195): a, c, t, g, unknown or other
  misc_feature (195)..(195): n is a, c, g, or t
tcagcagtagacgtcacgaccggtgctcgatttagtgtgagtagtttgggcgtgagctgggtttcctcgttgctctttaagaggtgtccagtgtcaggtgcaccgtggtggaatcgtgggggaggtccggtggtccgggcccttgggggggtccctgacgactcctcctgtgccatgtctgcgtctgaattccanccgtcaggtcctaacgtagtcggccagtcgctaccgtggggtcccgccgacgggcccccaggccgaacgggacttgggagtggggtggctatttagtacgtaatttgagtcggagtaattaaaactttcgcagccgtacgtagacgggtacccattacgacctatctaccaagacgtacccccttaccgaaccgactaccgcttacgtaacgttacctaacccaaaagtcggaaaccaggttcgggtacgaacgaaggttacggaacgtaccgaacggtacctaaactttacgttaagtacgtacgaacgtaaacgtacgttccggttacggttacgaagtcccgtaataccgtaacgttaggtaacgggttagtaccggggttacgtacccgttaccggtaacccgtaacccgggttaacgggggaacccgtaaaccggggaaaccgttaccggtttaaccgggttacccgttaaccccgggttacccgttacccgttacccggaacccgggttaccccgtaaccccgtaaaccccggtaacccggggtaccccccttaaccggggttaccccccggggtttaaccccctttaaccccccccggggtacccggttaccccccgttaaccccccggttaccccggttaacccccggtaaccggttaacccgggtacccccttaacccccggg

SEQ ID NO: 44176 - DNA, 906 bp, Homo sapiens
  misc_feature: GYAE6OF02IKADO.31.14.B03.1.454.CMB.1.raw
tcagcagtagacgtcacgaccggtgctcgatttagtgtgagtagtttgggctgagctgggttttcctcgttgcttcttttaagaggtgtccagtgtcaggtgcacctggtggaatcgtgggggaggcgtggtccggccgtggggggtccctgagactctcctgtgccatgtctgcgtctagaatttcatccctcacggcacttaatggccagtgaccacgtcgggtcccgccgacgggcccccgaagggccgaagggaccgtggggtacgggttagggggtcggtaccttaagttttaactaacgttaaagttttgaagtagggtaaagtaaaaatttaaaaaaaacgtttttaccggacctaacggtaacccgttaccgggttaggaaacgggggacccgtaacgttaccaaccctacttaccgtacccgaagtaaccgtaacccccttaccaaaccgtaactaccgcttacgtacctaccgtaaaccaaaatagtaactaagttacgggtaacgtacgtttaaggttaacggaaacgtaaccggtaaccggtaaaccttaaacgttttaagttttaagtttaacgggttacgtaaccggttaaaagggttacggtttttacgggtttacgggtttaacggaacggtacctaaagttaacgtaaggttgggttacgggttaagggttacggggtcggtacgttaaccggaccgtacccgggtagggacccggtaagggtaacccgtacggttccggtacccgttaccgtcccgtaccttaccccggaacgtccctaccccggtaaccggacccgggtacccgtaccggttcccggttaccccgttcccccggacggtccccctaccccgttacccgacccggtaactcccgacccgttacccggg

SEQ ID NO: 44177 - DNA, 855 bp, Homo sapiens
  misc_feature: GYAE6OF02HRSB4.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccaacggcccccagggcaagggactggagtgggtggctatttatactaatttgatggaagtaataaaaattttacgacagactccgtaggaaggccgattacaccatcctaccgagacgtacccttaccaacctatacgctagtactacctaccaaagttacgaactagttcgggtagaaccgtaaggttacggaaaacggaccgtaaccggggtacctaaaaccgttttaagttttaagtttcggttacgggaaccgggtaaaacgttacggtttttaccgggttttacggggtttaccggaacggttactaacgttaaccgtaaagttagggttaggggttaacggtttaaggggggttcggtaccggtacccgggtaaccgtaacccgggttcggggggaaccccggaagggggtaaacccgaccggtttacggggtaacccgtaaccccggtttcccgttaccccgtaccgtacccggtaccccctaccccggtaaacccgggtaaacccggggtcccccgttaaccgggttccccgggtttaaccccccgtttcccccccggttacgggtacccccttaccccccgttaacccgtaccccggaaacgggttacccgtcccggttaaacccccggg

SEQ ID NO: 44178 - DNA, 1155 bp, Homo sapiens
  misc_feature: GYAE6OF02IFK4Z.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctggggaggcgtggtcggcctgggggtaccctgagactctcctgtgccactgtctgcgtctgtaattcatcctcaggccaactagtggcatgcgacgtcgggtcccgaccgacggccccgaggccgaagggacgtggacggtgggtggctaagtttaactaactaacttttagaagtagggtaagtaaaactttaaaaaaagttttaaccggacctaacggtaaccttaccgggtacggaagggtccccgtaaatttaccaaaccccgttaactttaccgtaaccccgtaaccgtaaccgggtaacccccctttaacccgaaaaccgaacggttttaaaccccgaccgtttacggttaaccttaacccgttaaacccggtaaaaaagttaccggtaaaaaaccgtaaccggttaaaggggttacggttaaaacccgttaagggggtttaaacccgtaaaaaccgggttaaaccgtaaacccgggtttaaaccttaaaaaccgtttttaaacgtttttaaacggtttttaacgggttaacggttaaaaccggtaaaaacccggtttttaacgggttttaaccgggtttttacggggtttaacccggttaaacgggttaaccgttaaccggtttaaacgttaaaacggttcgggggtttaaagggttaacggggtttacggggttttaaccggggccgtttaaaacgggtacccgtaaaccccgggtttacgggggaaccccggtaaaaccggggggtaaaacccgtttaaccgggtacccgggtttaaccccgttaaaccccggtttacccgttacccggttaaaccccgtaccgggtaaaccccccgttttacccgggtaaaacccccggtaacccgggggttaaaccccccggtaacccggtttttccccgggtttaaccccccgggtttttaccccccgttaaccccggggttaaccccccgttaaaccccccgggttccgttttaaaccccccgaaaaccggggtaaccccgttaccccggtttaaacccccccgggg

SEQ ID NO: 44179 - DNA, 706 bp, Homo sapiens
  misc_feature: GYAE6OF02GQNNR.31.14.B03.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (437)..(437): a, c, t, g, unknown or other
  misc_feature (437)..(437): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctnaggcactatggcatgcacgtgggtccnccacggccccaggcaagggactgggagtgggtgctatttatactaatttgagtaggagtaaattaaaaagttttcgacaagacctcgtaggacgggtccattccaccatctccagacgtaccccttaccaacctataccgctagtactctaccaaatacgaactagtggtcagtacggttagaacgtaacgacggactaactttattattgtagagaaagtntttcggttaggtacgagtctagtacaagttggtaggtagtaggggttcggaccgttacggaccgtaaccgggttcgggggacccgtaaggggtaaccgtaccgttaccgggtacctacccggtttcctacccgttacgacccgtaccccttacccgaacccggaaccgggccccttaccggttacccgggtttcccttacccccggtcggaccccgttacccccgttaccccgtacccgaaaccggttaccgaccccgttaaccccggg

SEQ ID NO: 44180 - DNA, 723 bp, Homo sapiens
  misc_feature: GYAE6OF02I57DS.31.14.B03.1.454.CMB.1.raw
  modified_base (437)..(437): a, c, t, g, unknown or other
  misc_feature (437)..(437): n is a, c, g, or t
  modified_base (714)..(714): a, c, t, g, unknown or other
  misc_feature (714)..(714): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggaggcgtggtccggccgtgggggtccctgagacctcgtcctgtgccatcgtctgtccgtctgtaattcatcctacgagctactgtcggacagtcgctacgtcgggtcccgaccgacggcccgaggtaccgaacgggcgtggacgggttgggacgtactattaagtactaagttggagtaggaactaaaatttaaaaagtttccgagtacgtaccgtaccggtaggaacggtccgtactactaccgaatccgtaccgaagtaccgtaaccctacccgtaacacgtacgtctacgtactccgaaacatacgacttacgnggtactagtacgtaaggaacacgaaccgtgtaaacttgttagtaagtcgtaacgtaacgttagttcgggttacgtacgtagtacgtaaccgtgtaacgttaggaacggttggtaggccgtacgtcgaaccggtacggtcgggtaacggaaccggtacaaccgggttcgtaaccgtaccgttcgtccgacgtaccgtcccgtaccgaccggacgtcccgtaacggttcccgtacccgtcccgtaccgcccttacccgaccgttaccgacgtaccggtntaccccggg

SEQ ID NO: 44181 - DNA, 800 bp, Homo sapiens
  misc_feature: GYAE6OF02HL0F4.31.14.B03.1.454.CMB.1.raw
  modified_base (306)..(306): a, c, t, g, unknown or other
  misc_feature (306)..(306): n is a, c, g, or t
  modified_base (582)..(582): a, c, t, g, unknown or other
  misc_feature (582)..(582): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctggagactctcctgtcgccatgtctgcgtctagtaacttcactcctcgaggcctaactagtcggcattcggactacggtccggggtcccgccgaacgggcccccgaagggtacgaaacggggtacgtgggaacgggtggggtcggacttagtttaanacgttaagttaggagtaggaaagtaaaacgttaaaaaacgtttacgactacgtaccttacggtagggaacgggcctaacttaccaacctactccaacgagtaccgtacccctccaaaactataccgcgttatactacaacgtaacgactaaacagtaggtacgtaataggttaacgaacgtacgaacggtacttaacgttattagttcggtagaacgtaagtacgtttggttacgtaggactactaagtacgtagtggtaaggtaaggtttcgggnggttcaacggaccgtaccgggacgggacgtaaacgggaccgttaacggtcggtacctaccggtcctccgggtaacctaaccggcccgttaccccgaacgggtaaacccgggcccgttaaccggttcccgggtttacccccgtttacccccggagggttaccccccctaacccggtttaccccgaaccgtaacgggttaccgcccccgttaacccgggg

SEQ ID NO: 44182 - DNA, 798 bp, Homo sapiens
  misc_feature: GYAE6OF02G5VEB.31.14.B03.1.454.CMB.1.raw
  modified_base (219)..(219): a, c, t, g, unknown or other
  misc_feature (219)..(219): n is a, c, g, or t
  modified_base (259)..(259): a, c, t, g, unknown or other
  misc_feature (259)..(259): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctgagactctcctgtgccatgtctgcgtctgaattcatcctcaggcactatcggcatgcacgtcgggtccncgacgccccaggacgaagggcgtggagtgggtgctattanactaatttgagtggaagtaattaaaaagtttcgactaacgtacgtccggtaggaaacgggtcctattaccaacctagttcctaccgaaggtaacctacccctttacccaaacctacgtacccgtcttacgtaacttaccctaactaaaagtcgtaaaccgtagttacgggtacgtaacgtaaggttacggaaacggtaacgaaccggtaacttaaaccttttagtttaagttcgtaaggaaaccgttaaagtacgttttacgggtttcggttaccgaacgtctaacgtaacctaaagttggtaacgggtaaggttacggggtcgtcgttacgacgccgggttagggaccgtaacgggtaacgaccgtagggttacccaccggttccctaccgtacccgtacgtaccccctaccgtaacccgggaaccgggtcccccttacggttaccccggttacccccgttttaccccccgacggtaccccccttaaccccgtttaccccgaacccggttaagcccccggtacccgttaacccccggg

SEQ ID NO: 44183 - DNA, 855 bp, Homo sapiens
  misc_feature: GYAE6OF02HCDYG.31.14.B03.1.454.CMB.1.raw
  modified_base (171)..(171): a, c, t, g, unknown or other
  misc_feature (171)..(171): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtcngcgtctgtaattcatcctcgacggctactagtggcatcgccacgtcggggtcccaccgaccggccccgagggtaccgaaggggtacctggggtaacgggtcgggtacggtacttaagtttaagtaacgtaagtttaggagttaggaaaggttaaaactttaaaaaacgttttacgacgtaacgtaaccgttccggtaggtaaccggggaccgtaatttacccgaaccgtacgttacctacccggaaggacccgttaaccccctttacccgaaacccgtacgtaccgtcgttaacggttaccttaccgtaacctaaagtacgaacgtaagttcggtacgtaacgtaggttacgaaacgaccgtacggaacttaacgttagtttacgttacgtcgaaacgttaaagtcggttttacggttacggtacggtaacgaccgttaagtaacgtaagttcggtacggtaagggttacggggtacgtaccggtaaccgtaaccgggtaccggtccgggggaacgtaaaccggggaccgtcgtaccgggtaccttaacccggtccgttacctccgtaccgtaccccgttaccgaacccggaccggtacccgtaccgttcccgggttaaccccctcccggttccgtacccctccccgttacccgaaccgtaccggtacccgcgttaaccccggg

SEQ ID NO: 44184 - DNA, 911 bp, Homo sapiens
  misc_feature: GYAE6OF02F230J.31.14.B03.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctcgggggtccctgagactctcctgtgccatgtcngcgtctagattcatcctgagcactanggcagtcgactacggtcgggtcccgcgaccgggccccagggaccgaaagggtctagggtacggttggggcggtacttaagttttaacaaccgttaagttttggaagtagggtaaagttaaaaattttaaaaacgttttaccgacgtacggtaacccgttccggtaaggtaaccggggtaccttaacgttaccgtaaccgtacgttacccgtaccgtaacggtaccccggttacccctttaaaccccaaacccgttaacgttaacccgtcgtttaacggttacttaacccgtaaacctaaaacgttacgaaaccgttagttacggggtaacgaacgtttaaacggtaacggaaaacgtacccgtaaacggtaacccttaaacgttttaacgtttaacgtggtaacggtaaccgtaaaagtttcgttttacgggttacggtaaccgtaagttacctacgtaacgttagtacgggttaggtaacgttaggggtccgtaccgtaccggtaaaccggtccggggtacgggtaaccgtaacgggtaacctcgggttaccgtaacccgtaccgttcccggtaccctaacgtacccggtccccgtacccgaaccgggtcccggttaaccccttaccggttccccggttaccccgtttccccgtaccggtacccccttacccgttacccggaaccgtaaccggtccctaaccccggtcccgggg

SEQ ID NO: 44185 - DNA, 715 bp, Homo sapiens
  misc_feature: GYAE6OF02F0IWC.31.14.B03.1.454.CMB.1.raw
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcgaaagggctgggagtgggtggctatttanactaatttgatggaagaattaaaaaattttacganagactccggtaggaacgggccgtattaccacctatcctaccagacgaccccttccaacctatacgctagtactacctacctaaaagtcaaactagtagggtacgtaacgtagtttacggaaacgaaccgaacggtactaaaccttttaattagtttaggtacgaacgtaaaagtacgttttcgggtttaggttacgtaagtcctaattactaagttcggttagggtaaggttacggggtggtccgtacggaaccctaccgggtaggggacccgaacgggacctacggttcggtacctaccggtcctcccgtacgaccgtccctacccgaaccgaacggggtcccctaggttccccgttccccttacccccggtcggacccctccccgttaccctacccggaacggaccgcccgtaccccggg

SEQ ID NO: 44186 - DNA, 638 bp, Homo sapiens
  misc_feature: GYAE6OF02HMBXY.31.14.B03.1.454.CMB.1.raw
  modified_base (264)..(264): a, c, t, g, unknown or other
  misc_feature (264)..(264): n is a, c, g, or t
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
  modified_base (443)..(443): a, c, t, g, unknown or other
  misc_feature (443)..(443): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
  modified_base (593)..(593): a, c, t, g, unknown or other
  misc_feature (593)..(593): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctgaattcatcctcgaggccactagtggcatgcacgtcgggtccgccacggccccagggacaagggactggaggtgggtgactatttanactatttgatggaataattaaaatttcgacagtactcgtagacggtctatcaccatctacacgactacccttaccaactatacgntagtactctacaagtgaactagtggtanactagtagaacgacgacggtactaacttattaagtgtagacgtaaagttgtttcggttaggtcgancaattacaagtcgtagggtagtgggtgtccncggacgtaccgggngggaccggaagggactaccggttcggtaccctacccgttcgttccacgaccgtcccgtaccgaccggtaacggcccctaacgttcccggtccccttacccccggngtacccctccccgtacccgtacgaacggtcccgtacctacccggg

SEQ ID NO: 44187 - DNA, 815 bp, Homo sapiens
  misc_feature: GYAE6OF02HKJUG.31.14.B03.1.454.CMB.1.raw
tcagcagtagacgtcacgaccggtgctcgatttagtgtgagtagtttgggctgagctgggttttcctcgttgctcttttaagaggtgtccagtgccaggtcgcacctggtggaatcgtgggggagcgtggtccggcctgggggtccctgagactctcctgtgccatgtctgcgtctagtaattcactcctcaggcacgtagtggctaatgcacgtcgggtccaccgacggccccgaggaccgtaagggacgtgggaggtgggtcggacttaagtttactaacgttagttttaggagttagggaaataaagtttaaaaaaacttttccgagtaacggtaccttccgggtaaggaaccgggtaccgtaattaccgaaccgtacttaccgaccggaagtaacccgtaccccctttacccgaaaccgtaacgttacggtaccgttacgttactaacccttaaccgtaaaagtacgtaaacgtacgttcgggtaactacgtaaggttaagaaacggtacgaaccggtactaaactttatacgtttgaacgaacgtaaacgtagttcggtttaggtacgagtctactacgtaacgtgggtaacgtagggttagggtacgtaccgtacgaccgtaccgggtacgggacgtaacgggacgtaccggttggttaaccccgtccgttacccgtacccgtacgtaacccgcccgttaccccggaaacgaccccgggttaacccaaccggttccccggtttaaccccgttccccggtaaccggtccctaacccccttccgaaccccgtaagcccgacccgttaccgg

SEQ ID NO: 44188 - DNA, 771 bp, Homo sapiens
  misc_feature: GYAE6OF02FJ9ZH.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgtaattcactcctcagcactatggcatgcacgtcgggtccgccgacggccccgaggcgaagggactggaggtgggtgctatttactactatttagatggagtaaaatttaaaaaagtttacgacgtaagtaccgtaccggtaaggaaccgggaccgtacgttaccaacctacgttcctacccgaacgaaccgtacccccttaacccaaaccacttaaccgtccgtagttaacctaccgttaaccaaagtaacgaaactagttacgggtagtaacgtaaggttaacgaaagaaccgtaacggtaactaaacgttttatttaacgtttgtacgaacggttaaagtacgttttgggttttaccggttaacgtaggtactaacgttaccaaggttgttacggtaagttaggggttaccgtccgtaccggtaacgtaccgggttaccggggaacgtaacgggtactacgttcggtaccctcccgttacctacctccaacgtcccctaccgaccgaaccgggtcccgtacccgttacccggttccccttacccggtccgacccctacccggttaccccaaccgacgaccgtccctaacccggg

SEQ ID NO: 44189 - DNA, 691 bp, Homo sapiens
  misc_feature: GYAE6OF02G44AW.31.14.B03.1.454.CMB.1.raw
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctggatttcctcgttgctcttttaagaggtgtccagtgtcaggtgcacctggtggaatctggggagcgtggtccggcctgggggtccctgagactctcctgtgccatgtctgcgtctgtattcgattcctgacgctactagtcggcagtcgctacgtcggtcccgccgtacggcccgaggacgaagggacgtgggagtcgggngactagtttatactagttgagtaggtaataaacttaaacgtttcgacgtacgtacgtcggtaggacggtacctactaccgactctcctaccgacgtaccgtacctaccaactacgtacgtcgtatactacacaacgtacgaactagtacgtatacgtagtacgaacgtacgactacttaacgttattacgttacgtacgaacgtaacgttcgtttacggttacgtacgacgtacgtagtactagtggttaggtacggttcgggtcgtccgtacgtaccggtacggtaccgggacgtaacggtaccgtcggtacgtaccgtccgtacgtaccgtaccgtccgaccgtaccgtaccggtaccgtaccgttacggttcccgttaccccgtacccgtaccgtaccctacccgtaccgtaaccgtcgtaccgtaccgg

SEQ ID NO: 44190 - DNA, 629 bp, Homo sapiens
  misc_feature: GYAE6OF02FRU6E.31.14.B03.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (360)..(360): a, c, t, g, unknown or other
  misc_feature (360)..(360): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggcctggggggtccctgagactctcctgtgccatgtctgcgtctgaattcatcctnaggcactatggcatgcactgggtccnccacggccccaggcaagggctggagtgggtgctatttanacatttgatggagtaattaaaaattttacgacagtactcgtagacgggcctattacacctatctccagacgacccttaccaccatacgctagtactctacaatgaacngtgtcactagttagaacgacacggactaacttattagttgtgtacgtaaagtctttcggttggttacgagcctatctaagtgtagggtaagtagggtcgtctacgacctacgggtcgggaccgagggaacctcgttacggtccctaccgttcctcccgtacaccgtccctacccgaaccggacggtcccctaagtccccgggttacccctttacccccggcggtacccctccccgtacccgtacccgaacggtaccgacccgtacccgg

SEQ ID NO: 44191 - DNA, 912 bp, Homo sapiens
  misc_feature: GYAE6OF02GTH5E.31.14.B03.1.454.CMB.1.raw
  modified_base (188)..(188): a, c, t, g, unknown or other
  misc_feature (188)..(188): n is a, c, g, or t
  modified_base (283)..(283): a, c, t, g, unknown or other
  misc_feature (283)..(283): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctnaggcactatggcatgctacgtcggggtcccaccgacgggcccccagggaccgaaaggggactagggggacgttgggggtcggacttaagttttanaacctaatttgagttagggtaaggttaaattaaaaaaacgtttttaccggacgtaaggtaacccttacccgggttagggaaaccgggggtcccgtaacgtttaccgaacccctacgttacccgtacccgaaggtaaccccggttaccccccttaccccaaacccgtaacgttaacccgtaccgttacggttaaccttacctaaaccccgaaattaccggaaactacgggttacggtacgtacggtaagtttacggaaacgaacgtaaccggacttaaaccgttttagttaagtttcggtaggtaaccgttaaagggttcgttttaacggggtttcgggtttaccggtaaggtaccttaacggttaacctaaagggttgggtttacggggtagtttaacggggggtcgggtaccgttaccggtaccgggtaaccgggttccggggaaccgtaaccggggtaactaaccgggttcggtacccgtacccgtcccttccgaccgtaccgtccccgtacccgaccgtaacccgggtccctaaccgtttccccggggtcccccctttaccccggccgtaacccccgtccccgttaccccgaaccgtaacccgggttcgacccccgttacccgggg

SEQ ID NO: 44192 - DNA, 820 bp, Homo sapiens
  misc_feature: GYAE6OF02JP51W.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggttttcctcgttgctcttttaagaggtgtccagtgtcaggtgcactggtggaatcgtggggagcgtggtccgccgtgggggtccctgagactcctcctgtcgcctatgtctgcgtctagaattcatcctgaggtcactagtcggcatcgactacgtcgggtcccaccgtacggccccagggacgtaagggcgtaggngggtcggggctacttatttaagacttaagttaggctaggaagtaaacttaaaaacgtttcgacgtaacgaccgttacggaaggacgggtacctaagttacccgaaccgtacttaccgtaccgtaaggtaaccctaacccccttaaccgaaccttaacgggtaacctcgtttaacggttaaccctccttaaaccgtaaaggttaccgaaacgtaccgtttaggggcttaaccggtaaggttaccgaaaggtaccccgtaacgggtaacctttaaacctttaggtttacgtaggtacgtaacggttaaaacggttcgtttaacgggttttaccggtagtaacgtacttaccgtaaggtagtacgggttaagacgggtttaaggcggtccgtaacgacccgttacgggtacgtacgacggtaccgtaggtccgtacccgttcgtccttaccgtaccacgttcccgacccgtaacggtacccggtaccgttaccgtcgggtttccccttaccccggtactacccggttacccctaaccggcgttaacccggactttaccccggaccgg

SEQ ID NO: 44193 - DNA, 678 bp, Homo sapiens
  misc_feature: GYAE6OF02FIALK.31.14.B03.1.454.CMB.1.raw
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagacctctcctgtgccatgtctgacgtctagaattcatcctcaggcactagtggcatgcacgtcgggcccgccacggccccaggccgaagggctgggaggtgggtgctagtttactactaattgataggataaattaaaaacttcgacagcttcggaggacggcattccacntcctacagacgtacccttaccaacctatacgcttagtactacctaaccaaagttacaactagtacggtacaacgtaggttacgaacgacgtaaccggtacttaaacctttattagttgacgtaagaaagttcgtttcgttaggttacganactaacgttacaagtggttaggtaggtacgggtgtccgacgtaccgccgggtacgggccaacgggtacacgttcgaccttaccgtcctcgtacaccgtccctacccgaaccgacgggtaacccttacgggttaccccgttcccccgttaccccgaggtaccccctaaccccgtacccgtacccgaacggttaccctaccccgtaccgg

SEQ ID NO: 44194 - DNA, 883 bp, Homo sapiens
  misc_feature: GYAE6OF02JIIEN.31.14.B03.1.454.CMB.1.raw
  modified_base (189)..(189): a, c, t, g, unknown or other
  misc_feature (189)..(189): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctgggggtccctgagactctcctgtgccagtgtctgcgtctgtaattcatccctnaggctactagtcggcaatcgctacggtcgggtcccgaccgacggccccagggtacgaacgggacgttagggaggttcggggtaggtacctaattttaacgtaacttaagtttcggagtagggtaaataaacgtttaaaaaaacgttttccgacgtaacggtaccgtaccggttaagggaaccggggtaaccgttaactttacccgaaccgttacgttaccgtacccgtaacggaaccccggtttccccttaaaccccgtaaactaaccgttaaccggttccttaacgttaaccttacccgtaacttaaacgtaacggtaaaccgtaggttagggtacgtaaaccgttaagttacggaaacggacccgtaaacgttactttaaacttagtttacgttaaggtcgtaaaccggtaagttacgtttaggttcggtaacgtcgactacgtagtaacgttggtaggtaacgggttacggacgttaccggacctaaccggaccgggttaccgggggacgtaaaacggaccgtttaccgtaccgggttaccttcccggttcctaaaccgggtcccgtaaaccggttcccttaacccgaacccgggtaacggttcccgtaaccggttcccggttacccctccccggtacggtaccccttacccctacgttaaccggaacccgtacgaccccgtttacccggg

SEQ ID NO: 44195 - DNA, 772 bp, Homo sapiens
  misc_feature: GYAE6OF02GNACV.31.14.B03.1.454.CMB.1.raw
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggctgggggtccctgagactctctgtgccatgtctgcgtaccgaattcatcctcgaggcctactagtcggcagtcgctacgtcggggtcccgccgtaacgggcccccgaagggccgtaaaggggtcctggggaggttggggtaggacctaattttagtaacgtaagtttgacgttggaagtaaagtttaaaaaatttccggcgtaagtaccttacccggtaggaacgggtacctattaccgaacctataccgtaccaaggtacctaccccttaccgaaacctacgtaccgnttacgtactaccgtaccgaaagttacgaaactagtagggtacaacgtaaggtttacggaacgtaccgacggtaactaaactttgttagttcggtagaacgtaagtacgtttcggttacggtacgagtactacgtacgtaagttgggacggttaggttaggggtacgtacctacggtacgtaccggtacggggtaccgaaggtaccgacggttccgggtaaccgaccgtttccaccgtcaccgtccgtaaccacccggtaacggcccttcggtacccggttcccgttaccccggtaccggtcccttaccccgttccgtaacccggaccgtacgtcccgacccgtacccgggg

SEQ ID NO: 44196 - DNA, 920 bp, Homo sapiens
  misc_feature: GYAE6OF02IOES0.31.14.B03.1.454.CMB.1.raw
  modified_base (226)..(226): a, c, t, g, unknown or other
  misc_feature (226)..(226): n is a, c, g, or t
tcagcagtagacgtcacgaccggtgctcgatttagtgtgagtagtttgggctgagcgtgggtttctcgttagctcttttaagaggtgtccagtgtcaggtgcacctggtggaatcgtgggggagcgtggtccggcctggggggtccctgagctctcctgtgccatgtctgcgtctgtaattcactcctcacggctacgttatgggctatgccacgtcgggtacccnccgacggcccccgagggacgaacggggtacgtagggtagggttcgggtggaccttaagtttatacgttaagtttacggtagtaagggactaaaactttaaaaaacgttttaccggacgtaacgtaccgtaccggtacgggacgggtaccttaacttaccccgaacctacgttaccctacccgaacggtaacccgttacccccctttacccgaaaccgttaactacccggtgtttacgttaaccttacccgtaaccgaaaagttccgtaaacgtacggttaagtaccggtaactttaaggttaccgaaaaacgtaccggtaaaccggttaccttaaaaccgttttaaggtttaacgtttagggtaacggttaaacggtaaaacggtttaacggtttttccgggtttaagggttaccgtaacgtaccgtaacgttaacgttaacggtttaggtacggggtttaacgtacggggttacggtcccgttaaacggaaccgacccggggttccgggaaaccggtaaccggtaccgacgggttaccgtacccgtaccgttccgtacccgactacccggtacccaccgtaacccgggtaccggtccctaacccggttcccggtttcccccgttaaccccgtcccgtacccctacccccgtttaacccggactaaacccgggtcccaacccggttaccccggg

SEQ ID NO: 44197 - DNA, 792 bp, Homo sapiens
  misc_feature: GYAE6OF02IAR5Z.31.14.B03.1.454.CMB.1.raw
tcagcagtagacgtcacgaccggtgctcgatttagtgtgagtagtttgggctgagcgtgggtttcctcgttgctcttttaagaggtgtccagtgtcaggtgcactggtggaatcgtggggaggcgtggtccggccgtgggggtccctgagactctcctgtgccatgtctgcgtctgtaattcactcctacgaggactactagtggacagtcgaccacgtcgggcccgccgacggcccgaggaccgaagggcgtagggtaggtgggtcgtctaatttagtactaagtttgagtaggaactaaaatttaaaaacgttcacgtacggtacttaccggagaaacggggcctaattaccacctagtcctacgagacctaccctaccaaacataccgtcttacgtactccaaccgtaaagtcgtaaacgtgtacgggtacgaacgttaagttaggaaacggtaccgaccggtaactttaacgtttataacgtttggaaccgtaagttaaggtaccgttttacgggttacggtacgtaacggtacctaagttacgtaaggtttaccggtaagggttacggtacggggtcggtccgttacgggacgtaccgggttcggggaaaccggtacggtaaccgtacggtaccgggtcctaacccggttccaccggttaccgtaaccgcccgtaaccccggtaccgtaaccggggtcccttacggtaaccccgggtttcccttacccccggccgtacccgttaccccctacggttaaccggaaccctccgggttaccctacccggg

SEQ ID NO: 44198 - DNA, 628 bp, Homo sapiens
  misc_feature: GYAE6OF02HX9JF.31.14.B03.1.454.CMB.1.raw
  modified_base (222)..(222): a, c, t, g, unknown or other
  misc_feature (222)..(222): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgttggtccggcctggggggtccctgagactctcctgtgccatgtctgcgtctgaattcattcctcaggcactagtggctagtgcacgtgggtcccnccgacggcccgaggcgaagggctggaggtgggtgacttattatactaagttagtagtaggaagtaaattaaaacgttacgacgtacgtacgtacggtacggacggtacgtactacactactccaccgtacgacctaccctaccaactacgtacgtctacgtactactaactaagtacgtatagtagtctagtagtacgaacgacgacgtactaattagttagtagtacgtagtaagtagttacgttgtagagtatagtactagtagtaggtaggtggtcgtcgtacgacgcggtacggacgacgacgtacgtcgtccgtcgtctcgtctcgaccaccgaaccgtacgccgtccgttccgtcccgtcccgccgtccctacctaccgtaacgacgtaccgtccgtccg

SEQ ID NO: 44199 - DNA, 866 bp, Homo sapiens
  misc_feature: GYAE6OF02IX15X.31.14.B03.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccgaggcgaagggactgggaggtgggtggctatttanaactaatttgagtaggagtaaaattaaaaaatttttacgacaacgtaccttaccggtaggaacggggaccgaactttaccaaccgactcctaccgaacgaccgtacccccttacccaaaccacgttaaccgcgttacgttactaccgtaacctaaaagtacgtaaactagttcgggtacgaacgtaaggttacgaaaggaaccgtaaccgggtaccttaaacgttttaactttagtttacggtacggtaaacgggtaaagtttagttttaccgggttttggggtttaccgtaacggtactaacgtttaacgtaaaggtttgggtaggggttaaaggttagggggttacgggtacccggttaaccggaacccggtaacccgggtacggggggtaccccggtaaacgggggtaaacccgttacggttcgggttacccgtacccgggtttaccctaccccggtaccgtaccgtacccccgtacccgtaaccccggtaaccggggtcccccttaccgggttaccccggttccccccggtttacccccgtccgggacccccttaccccgttcccccgtaaccggaacgtacccggtcccctaaccccgggg

SEQ ID NO: 44200 - DNA, 860 bp, Homo sapiens
  misc_feature: GYAE6OF02GLITK.31.14.B03.1.454.CMB.1.raw
  modified_base (214)..(214): a, c, t, g, unknown or other
  misc_feature (214)..(214): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctggagactctcctgtgccatgtctgcgtctgaattcatcctcagcactatggcatgcagtcgggaccnccgacggccccaggccgaaagggtctaggacggtggggtcgtactaagttttaacaactaagttttcggaagtagggaagttaaaactttaaaaaacttttccggagtaacgtaccgttccggtaaggaacggggtcctaactttccgacccgtatccctccgaagtaacccgtacccccttaccgaaacctgtacccgtcttagttactcgaacctaagtacgaactggtcgggtacaacgttagtagaaccgtacgaacgtattaacgtttacgttaagttagcgaacgttaaagtggttttcggtttaggtacagtacgttactaacgtagttacgggtaggttacggttaggggtccgtaccgtaaccgtccggtaaccgggttccggggtaaccggaaaccggggtaacctccggttttaccgggtaccccggttacccgttacccgttaccgttcccgaaccggttcccccgtaacccggtaaaccccgggtacccggtaacccccggttaccggtttaccccccgggttttacccccggtttacccccccgggttggttaacccccccccgttacccccgttaccccgttaaacccgggtaacccggtaccgggttaaccccccgtttacccccggggg

SEQ ID NO: 44201 - DNA, 788 bp, Homo sapiens
  misc_feature: GYAE6OF02H4DJM.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtggggggtccctgagactctcctgtgccatgtctgcgtctgtaattcatcctcaggcactatggctatgcacgtcgggtcccgccgacggccccgacggacgaagggacgtgggaggtggggtaggactaatttataacgtaatttgagtaggaataaattaaaaagtttacgacagtactaccggtaggaacgggtactactaccaacctactccaccacgtaccgtaccctaccaacctaataccgactacgtactacctaacgtaaatagaacttagtcgtacgtacgtagttacgaaacgccgaacgtaacctaagttatagtttagacggtaagtaacgttggtttacgtttcggtacgaacgtactacgtaacttaaggtaggtaggtaggttacggggtcgacgttaccgaccggtaacgggtcgggtaaccgggaaggtaccgtaacggtcccggtacccgttaacccggtccttaacccgtaccgaaccgtcccccgttaccgaaccccgggtaaccccgggtacccttaccgggtacccccggtttaccccggtttacccccccgtcggtaccccccctaaccccggttaacccccgtaaccgggaacccggttaccccggtaccggttacccccgggg

SEQ ID NO: 44202 - DNA, 784 bp, Homo sapiens
  misc_feature: GYAE6OF02G7EWN.31.14.B03.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatgcatgcacgtgggccncaggccccaggcaagggctgggagtgggtgacatttanactaatttgatggaagtaattaaaaaaagttttcgcgaagactaccgtaggaagggacctattacgaaccatacctacacgtacgaccccttaccaaccagtaccgcgttagacttacctactaaacgttacgaaaccagttgggtacgaacgtagttacggaaacgtacgaaccgggtactaaaacgtttatttaagtttcggtaacgtaacgtaaacggttaacgtttacgggttttacgggtttacggtacgtacgaaccttaagaacgtttaggtagggtaacgttaggggtacgggtaccgtaccgggtaacctaacccgggttacggggacccggtaaacggggaaaccgtacgggttacgggtacccgtaaccccgttcccgttaacccgttaccgtaccgtccccgttacccgaaacccggaacccgggtccccgtaaccggttcccggtttaccccggttacccccgttccggtacccctaccccgttacccgtacccgaaaccggtacgtaccccgtaacccgg

SEQ ID NO: 44203 - DNA, 740 bp, Homo sapiens
  misc_feature: GYAE6OF02JYXV5.31.14.B03.1.454.CMB.1.raw
  modified_base (225)..(225): a, c, t, g, unknown or other
  misc_feature (225)..(225): n is a, c, g, or t
  modified_base (340)..(340): a, c, t, g, unknown or other
  misc_feature (340)..(340): n is a, c, g, or t
  modified_base (414)..(414): a, c, t, g, unknown or other
  misc_feature (414)..(414): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggccgtggggggtccctggagactctcctgtgccatgtctgcgtctagaattcactcctcaggccactatggcagtgctacgtcgggtcccnccgacggccccaggccgaagggactgggaggtgggtggctattatactaagttgagtggaagtaattaaaaagtttcgacaacgtactccggtagaagggcctaagttccaaccntcctaccagacctaccccgtaccaaacctcgtacgccttagtactaccgtacaaatcgaatagtgtaccgtaanacggttagaaacgaaccgtacgaacgttaactttaattagttacgtagtaacggtaaggtaacttttcggtagggttacacgtactaactagaggttaggnggttaacggtggtcggaccgttacgaccgtaaccggggtccggggaaacgtaacggggtaacctacggtttaccggtacccgtaaccccgggttcctccctaaccggtacccgtcccgtacccgaacccggtaacggggtccccctaacggttacccgggttcccccttaccccggtacggaccccttccctaaccccggacctaccggtacgtcccgtacccgg

SEQ ID NO: 44204 - DNA, 710 bp, Homo sapiens
  misc_feature: GYAE6OF02HLG70.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggtgggtccctgagactctcctgtgccatcgtctgcgtctagtaattcatcctgaggcactagtggcatgctacgtcgggtcccgccgtacggccccgagggtacgaacggggtacgtcgggaggtggggtacgtctaatttactaactaagtttgagtaggaagtaaaagttaaaactttcggacgtagtaccgtcggtaggaacggtctacttaccaactactcctacgagtaccgtacccttacaacctactacgcttagtaactctaacaaatcgaacgtgcggtacgaactacggtaagaacgacgacggtactaatttatacgtagtagaacgtattcggttacggttacggtacgacgtactaacgtactaaaggtcggtaaggttacggtggggtctaaccgtacggaccggtacgggtaccgggaccggtacgggtaactacggttccgacgttacccgtctaccgtacgtaccgacccctacgaccggtaccggtccgttacgtccccggtccccgttaccgtcggtacccctaccccgtacgaccggtagacccgtcccgg

SEQ ID NO: 44205 - DNA, 869 bp, Homo sapiens
  misc_feature: GYAE6OF02JP25Q.31.14.B03.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggaggcgtggtccggctggggggtccctgagactctcctgtgccatgtctgcgtctgaattcatcctnaggcactatggcatgctacgtcgggtcccgccgacggccccagggacgaacgggactgggtaggtggggtcggacttaatttactaacgtatttacggagttggaaacggttaaatttaaaaaaacgtttttaccggccaaaaaacgttcccgttaccgggttaaggaaacggggcccgttaactttacccgaaccgtacgttacccgttaccgaaacgggtacccgtaaccccctttaaccccaaacccgtaaagtacccgtacgttacttaaaccgttccgtaaacctaaaacgtacgaaacgtacgttacgggtacgtaaaccggtaggttaacggaaaccggtaaccaaccggtaacttaactttaattacgttgtaacgaacggtaaacgttacggtttacggtttacgggttacgaggtaccgtaatacgtaacgttagggttaggaacgggtttaggggtccgtaccgttccggaaccctacccgggggttaggggaacccggtaagggtaaacccgttcgggtaccggttcccttaccggttaccctccgttaccggaacccgttcccgtacccggaaaccggcggttaccccgtacggttccccgtccccgttacccccgtacgacccccttacccgttaccggtaaccaacggtcccgtcccgttaacccggg

SEQ ID NO: 44206 - DNA, 714 bp, Homo sapiens
  misc_feature: GYAE6OF02I2XT2.31.14.B03.1.454.CMB.1.raw
  modified_base (159)..(159): a, c, t, g, unknown or other
  misc_feature (159)..(159): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagttgggctgagctgggttttcctcgttgctctttaagaggtgtccagtgtcaggtgcacctggtgaatcgtggggagcgtggtccggcctgggggtccctgagactcgtcctgtcnccgatcgtctgcgtctgaactcatcctagnggacactntggcagtgacctcgtggtcccnccgacgtaccccgagcgaaagggtcgtgggaaggttggactatacgtttanacctaagttgatacggataaacgttaaaactttccgatacgactcggtaaggtacgcgttataccgactacctaccgtcgaacgtaccgtcccttaaccaaccctaagtacccgtttcaccgtactaccgaatacgaacctggttacgggcctaatcgggtanaacgtacgaacgttctaaagttccttaagtcgagtaagtccgtttgtacgggtacttcgacttatacggtaaagttccgtcgggtagtaacggtgacccgttaacgacgaacccggggtgaaacggacggtaactacggttaaccggtccctacgttaccgtaacgtcgaacccgtccttaacccgacgtcggcccgtaaccgttcgttaccccgtacccctacggtcccttaaccccgtttcggaccctaacggacccgttaccgttccgtaacccgggg

SEQ ID NO: 44207 - DNA, 715 bp, Homo sapiens
  misc_feature: GYAE6OF02GIZ03.31.14.B03.1.454.CMB.1.raw
  modified_base (335)..(335): a, c, t, g, unknown or other
  misc_feature (335)..(335): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctgggggggtccctggagactctcctgtgccatgtctgcgtctgaattcatcctcaggcactatggcatgcacgtcgggtcccaccgacggccccaggacgaagggactgggaggtgggtggctattataactatttgataggaagtaaattaaaaactttcgacacgtactccggtaggaacgggcctacttccaaccntacctccgaagaccgtacccctacaaccataccgtcttagtactaccgtaacaaagtcgaaactagtaggtacgactaaggtacggaacgacgaacgtacttaactttagttacgtttcgagtaacggtaacgttacgtttggttacgggtacgagtactaattacgtaaggttgggtaggtacggttagggtacgccgttacggaccgtacgggtcgggtaaccgaacgggtaacgtccgggttacggtacccgtcccgttcgtacccgtactaccgccccgttaccgaacccggtacccggtaccctacgttcccggtccccttccccgtccggtacccctccggtaccctaccggaccgtaccgtcccgtacccggg

SEQ ID NO: 44208 - DNA, 840 bp, Homo sapiens
  misc_feature: GYAE6OF02IVXNJ.31.14.B03.1.454.CMB.1.raw
  modified_base (272)..(272): a, c, t, g, unknown or other
  misc_feature (272)..(272): n is a, c, g, or t
tcagcagtagacgtcacgaccggtgctcgatttagtgtgagtagtttgggcgtgagctgggtttcctcgttgctctttaagaggtgtccagtgtcaggtgcaccgtggtggaatcgtggggagcggtggtccggccgtcgggggtcctgagctctcctgtgccatcggtctgcgtctagaacttcactcctgacggcctacgtagtggccagttacggccgtacgtcgggtcccgaccggaccggcccctagggacgaaagggtcgtagggnggtcgggtcggctaattttacgtaacgtagtttaggacttaagggtaaactaaagtttaaaaaagttttccggactaacggtaaccgttaccggtaacgggaacgggaccctttaacgttaccgaaccctaacgttccgtaccgaacgtaacccggtacccttacccgaaacgtacgtacgtcttacgtatacctactaaatcgaactgtacgacgacgtaggtacgaacgtaccacggtaacttaaacttctttacgtacgacgtacgtaaacgtttacgtttgggttacgggttacgacttacgacgttacgtaacggttcggaaggttaggttacgggtacggtacgtacgaccgtaccgggtacgggacgtaaacgggaccgttaacggaccggttaaccgtccgttaaccgttacctaccgttaaccccggtccctaaccggtccggtaaacccggtccccggtttaacgttaccccgggtttaaccccttccccgggttacgtaccccgttaccccgggttaccttaaccccgggacgttacccggacccgtttaccccggg

SEQ ID NO: 44209 - DNA, 963 bp, Homo sapiens
  misc_feature: GYAE6OF02FTBK7.31.14.B03.1.454.CMB.1.raw
  modified_base (224)..(224): a, c, t, g, unknown or other
  misc_feature (224)..(224): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtgggtccggccgtggggggtccctgagactctccgtgtgccatgtctgcgtctagaattcactcctcaggcactagtggcatgcacgtcgggtcccnccgaccggccccaggacgaaagggcgtgggaggtgggtcgtacttagtttaactacttaagttttagagttaaggaagtaaaaattttaaaaaacgttttccgacgtaaacggtaccgttacccggtaagggtaaccgggggtacccttaagtttacccgaaccgtaacttaccgtaccccggtaaacggtaaccccggtaaccccccttttaacccgaaaccttaaacgttaacccgtaccgtttaacggtttaacccttaaccccgttaaaccaaaaagttaccggtaaaaccgttacggttaacggggtaacgtaaacgttaagggtttaaacgaaaacggtaaccggaaaccggttaaccttaaacgttttaaatttacggttaggtacggtaaacgttaaaagttcggttttaccggttacgggtttaacgacgtacgtaacgttaacggtaacgttgggttaacgggtaaggtttacggggttaccgtacccggttacgtaccggttaccggggtaccgggggaacccgtaaaggggtaaccctcggggtttaccggaccccgttaaccgttcccgttacccgtaacgtcccgtaccccgtaacccgaaacccgggtacccgggtccctttaaaccgggttccccggtttaacccccccgttcccgtaccgggtacccccttcccccggtttaaaccgacccggtaacgggtcccgtacccgttaccccgggg

SEQ ID NO: 44210 - DNA, 833 bp, Homo sapiens
  misc_feature: GYAE6OF02FZS73.31.14.B03.1.454.CMB.1.raw
  modified_base (185)..(185): a, c, t, g, unknown or other
  misc_feature (185)..(185): n is a, c, g, or t
  modified_base (215)..(215): a, c, t, g, unknown or other
  misc_feature (215)..(215): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggccgtgggggtccctgagactctcctgtgccatgtctgcgtctgattcatcctnaggcatagtggcatgctacgtcgggtcccnccgaccggccccgaggacgaaagggtacgtgggaggttcggggtcggactaagttttaacaaccgttagttttagacgtgggaaagttaaaaatttaaaaaacttttccggacgtaacgtacgtcggtaggaacggtcgtacttaccacctacgtctaccgaagtaccgaacccttaccaacgtacgtacgtcgttcgttaactacctaaaccgaaaattacgaaacttacgtgggtaactaacggttagttaagaaacgaacggtaaccgtactttaaaacgtttattagtttacggagtaaccgtaaaggttaacgtttcggtttaacgggttcgaacgtaccgtaagttactaacgtaggttagggttaagtacggggtttacggaccgttaaccggacccgtaccgggtaccgggtaccgggaaaccgggtaacgttaaccggttccgggtaaccgtacccgggttacctccccgtaccgaaccgtaccccgtacccggaacccgtaccgggggaacccttacccggtttcccggttacccccgtttccccgggtaccgaccccttacccccggttacccgaacctaacccggttacccacccggttacccggg

SEQ ID NO: 44211 - DNA, 788 bp, Homo sapiens
  misc_feature: GYAE6OF02GIDVP.31.14.B03.1.454.CMB.1.raw
  modified_base (507)..(507): a, c, t, g, unknown or other
  misc_feature (507)..(507): n is a, c, g, or t
tcagcagtagacgtcacgaccggtgctcgatttagtgtgagtagtttgggctgagctgggttttcctcgttgctcttttaagaggtgtccagtgtcaggtgcaccgtggtgaatcgtaggggaggcgtggtccggccgtgggggtccctgagactctctgtgccatgtctgcgtctagacttcactccctcaggaccactagtggactagtgccgtacgtcggggtcccaccgaccggacccccgagggaccggaacgggtcgtaggggtacggttgggggtacggacttattttaactaactaagttttgagtagggtaagtaaaaatttaaaaacgttttcggaactaacgtaccttcgggtaggaaaccgggtccttaacgttacaacccgtactacccttaccggaaacgtacccgtaacccccttacccaaccttacgtacctccgttatacctaccctaaacgaacgttactaactaggttacgcgtaaccgaggttaaanaccggtaatacggtaaccttaacgttttaagttacttggtagtaacggaaacgttaggtttccggttacggtacgactagtacgtataacggttggtagttacggtagggtcgtaccgtacggtaccgagggtaccgggacgacgggaaacctttcggcggtaaccgtcccgttaccgcccttacgacccgtaccctacccgaaccgggtacgtacccctaccggttcgtaccccctccggtaccgtaccctcccggtaccctccgacgaccgccgtccgg

SEQ ID NO: 44212 - DNA, 735 bp, Homo sapiens
  misc_feature: GYAE6OF02GTDDI.31.14.B03.1.454.CMB.1.raw
  modified_base (185)..(185): a, c, t, g, unknown or other
  misc_feature (185)..(185): n is a, c, g, or t
  modified_base (464)..(464): a, c, t, g, unknown or other
  misc_feature (464)..(464): n is a, c, g, or t
tcagcagtagacgtcacgaccggtgctcgatttagtgtgagtagtttgggctgagcgtggtttcctcgtagctctttaagaggtgtccagtgtcaggtgcacctggtggaatctgggggagcgtggtccggcctggggggtccctgagctctcctgtgccatgtctgcgtctgaattcatccctnaggcactagtggcatcggcacgttcgggccgaccagggcccccgaggacgtaaagggccgtggaggtgggtcggactaagtttataacgttaatttgagtagggtaataaatttaaaaaacgttttcgacgtagaccttacgggtaggaacggggtcctacttaccgacctattcccgtacgtaacgtaccgtaacccccttaccaaaccgtacgtaccgtcgttacgttacttaccaacctaaagttacgaactagtggttaccgagtagtaacgaanaccgaacgtactaattacttagtcgatacggtaaatcgtttagttcggttagactacgtatacgtagtcgtaaggtaggtacgggtacgtccgtaccggtaccgaccgggtacgggacgtaaagggtaccgtaccgttggcccttaacgttcctacccgtacacccggttccacccgtacccggaacggtcccctaacccgggtccccgtttaacccgtccccgacggtaccctcccggttacccgaactaaccggcctccgtaacccggg

SEQ ID NO: 44213 - DNA, 1016 bp, Homo sapiens
  misc_feature: GYAE6OF02GGLCT.31.14.B03.1.454.CMB.1.raw
tcagcagtagacgtcacgaccggtgctcgatttagtgtgagtagtttgggctgagcgtgggttttcctcgttgctcttttaagaggtgtccagtgtcaggtgcacctggtggaatcgtggggagcgtggtccggccgtgggggtccctgagactctcctgtgccatgtctgcgtctgaattcactcctgaggcactagtcggctagtcgcgtacgtcgggtcccgccgacggcccccgaggcgaaacgggtactgggaggtgggtcggacttaagttttaacgtaacttaagtttcgaagtacgggaattaaaagttaaaaaacgttttcgacgtaacgtacctacggtaaggacggtaccgtacttcccaaccgtagtcctaccgaacggtaacccgtaaccccctttacccggaaaccctaacgttaacccgagttttacggttaaccgttacccttaaaccgtaaaacgttaccggtaaaaccttacggtttacggggtaactaacgtttaaagggtttaacgggaaaacgttaaaccgtaacccgggtaaactttaaacgtttttaaccgttttaacggtttaccgggttaacggtaaaccggttaaaaggtttaccgtttttaccggggtttaacggttaccgggtacgtaccgtaaacgttacgtaaacggttacggttaggggttaacggttagggggttacccgttaccgttaccccgggtaacccggttaccggggtaccggggttaacccgaacggggttaaacccgtaacccgggtttaccggttaccccgttaaccccggttcccgtttaaccccgtaccggtaaccccttcccccggtaccccgttaaaccccgggtaaccccgggtaacccgttaaccggtttcccccccgggtttaacccccctttacccccggggtaccccggtttaacccccgacccccccggtttacccgtaaaacccccgggtacggttaaccccgtacccccgttaacccccgggg

SEQ ID NO: 44214 - DNA, 730 bp, Homo sapiens
  misc_feature: GYAE6OF02FHDPZ.31.14.B03.1.454.CMB.1.raw
  modified_base (265)..(265): a, c, t, g, unknown or other
  misc_feature (265)..(265): n is a, c, g, or t
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtcccggcctgggggtccctgagacctctcctggtgccatgtctgcgtctgaattcatccgtcaacggctactatcggacctatgcctacgtcgggtccgccacggccccaggaccaacgggtactgggagtgggtcnctatttacaactagttcgatggacgtaaattaaaattcgcagcgtcgtgacggcatcaccntcacagtaccgaccttacacagtacgtctagtactctaacctaancgaacgtgtacggtacgacgtagttaggaaactacggacgtacttaaacgtttaactttattacggacggtaaccggtaaaaggtttcgtttacggggtttacggtaccggtaagtacttaacgttacggaaacgtttgggtaacggtaagggttacggggttcgaccgtaccgggtaacctacccgggggttcgaaccggtagggaaaccttcggtacggtcctaacccggtcccttacgcccgaacctcccgtaccgtaaccggtaacccggtccgtacccggtttcccggtaccccctttcccggaccgtacccttacccccgtacgttacccgaacggtcctaccggttaccccg

SEQ ID NO: 44215 - DNA, 786 bp, Homo sapiens
  misc_feature: GYAE6OF02F93RY.31.14.B03.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
tcagcagtagacgtcacgaccggtgctcgatttagtgtgagtagtttgggctgagctgggttttcctcgttgctctttaagaggtgtccagtgtcaggtgcactggtggaatcgtgggggagcgtggtccggcctggggggtccctgagactctcctgtgccatgtctgcgtctgaattcatcctcaggcactatggcatgcacgtgggtccncacggccccagggcaagggctgggagtgggtcgctatttanactaatttgattggaagtaataaaaaattttacggactaagtacttccggtaggaacgggtcctaagttacaaccattcctaccaaggtacgaacccctttaccaaacctaactaccgtactagttaacgttacctaacctaaaatacgaaaccgtagttacggtacgtaaccgtagttaacggaaacgtaccgtaaaccggtacctaaacgtttactttaagttcggttaggtaaccgtaaaaggtacgtttacggttcggtttacgacgtacctaacgttaacaagttcggttagggtaacgttagggggtcggtaccttaccggaaccgttacccgggtagggggtaacccgtaaggggaaccgtacggtaccggttacccgtaacccggttacctacccgttacgacgtcccctacccacccggtaaaccgggtcccctaacgttacccgggttccccttaccccggttccgtaaccccgtacccccgttaaccgtaccctaaacggtccgtacccttaaccccgggg

SEQ ID NO: 44216 - DNA, 689 bp, Homo sapiens
  misc_feature: GYAE6OF02FZKWZ.31.14.B03.1.454.CMB.1.raw
  modified_base (189)..(189): a, c, t, g, unknown or other
  misc_feature (189)..(189): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggctgagctgggttttcctcgttgctctttaagaggtgtccagtgtcaggtgcacctggtggaatctgggggaggcgtggtccggcctggggggtccctgagactctcctgtgccattgtctgcgtctagaattcatcctnaggcactatggcatgcactgggtccgccacggccccaggcaagggactgggagtgggtggactagtttacactaattttgatggagaaattaaaaattttcgactagaccttaccggtagaaggggcccgtattccacctatcctaccagacacccttaccgaacctatacgctcgtatctccaatgtaacagtggtnacagttagaagacgacgactaaacttnttatgtacgagtaaagtntttacggttggtacggtagctaatcgaatgggtaggtagtaggggtcggtctacgacctaccgggtggggacccgtagggaacctcgttcggtacctacccgtcgtaccctcgaccggtcccctacccggaacgaaccggggtacccccgtaaggttcccccgggtttaccccgtttacccccccgtgggtaccccgtacccccttttacccccggtaacccggttaacgggtacccgtacccggttaacccccggg

SEQ ID NO: 44217 - DNA, 884 bp, Homo sapiens
  misc_feature: GYAE6OF02GJTHB.31.14.B03.1.454.CMB.1.raw
tcagcagtagacgtcacgaccggtgctcgatttagtgtgagtagtttgggctgagctgggtttcctcgttagctctttaagaggtgtccagtgtcaggtgcacctggtggaatctgggggagcgtggtccggcctggggggtacccctgagactctccgtgtgcccatgtctgcgttactgaattccaatccctcgaggtcaactagtggcctatgtccacgttcggggtcccgcccgaacgggcccccagggtccgaaagggtacctgggaaggtggggtcgcctaatttaacaacgtaagtttgagtaggaactaaattaaaaacgtttacgacgtaacggaccgttacggtaggaacgggtccgtaacttacctaaccgtacttaccgtaccgaacggtaacccgttaaccccttacccgtaaacccgtaacgtaaccggccttcggttaactaccgtaacccaaaagtcggtaaactacggtagggttaccgtacggtaaggttaacggaacgtaaccgtaaccgggtaacccttaacgtttaacgtttacgtttacggtaaggtaaccggttaaaaggttaccgtttgggtttaacggtttaccggaaggtaccctaacggttaaacgtaacggttcggttaacgggttaaggttaacggggtacgtaccgttaccggaacccgtaccgggtacggggtaacccgtaacgggtaaccgtacgtacccggggttacctaacccgttccgtacccggtacgtaccctacccggttacccgaaccggtaaccgggtcccctaacggtttccccggtacccgtttaccccgaccgtaccccgttaccctacccgtacccgaacggtaccgtcccgtaacccgg

SEQ ID NO: 44218 - DNA, 943 bp, Homo sapiens
  misc_feature: GYAE6OF02JOCUF.31.14.B03.1.454.CMB.1.raw
  modified_base (275)..(275): a, c, t, g, unknown or other
  misc_feature (275)..(275): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtcccgccacgggcccctaggccgaaaggggtacctggggaggttggggtacggactaattttanaactaagtttgacgtaggaagtaaattaaaaaagttttaccggataacggtaccttccggttaaggaacggggtacccctaatttcccaaccgtaacttccgacccaagggtaccgtaccccctttaacccaaaacctaacttaaccggtcttaacggttaccttaccgtaacccctaaaaagtaccggtaaaccgtaagtttccggggtaacgttaacggtaaacggtttaacgggaaaacggtaaacctaacccggggttaaccttaaacgttttaacgtttttaaaccgtttagggttaacgggtaaaccccgggtaaaaggttaaccgtttttaccggggtttttacgggttttaacggtaaccgggtaccgtttaaacgtacggttaaatttagggggttaccggggttaaggttttaaccgggggttcgggtaaccgttacggtaaccgtacccgggttacggggggtaccgtaacggggtaaacccgtacggtttaccggggttaccgtaacccgtttcccgtaaccgttccgaacgtccccgtaccgaacccggtaaccggccccgttacttacccggggttacccccttcccccgtaccggaacccgttacccccgtttacccgttaacccgaaacgggttccaacccgttaccccggg

SEQ ID NO: 44219 - DNA, 708 bp, Homo sapiens
  misc_feature: GYAE6OF02IIZTM.31.14.B03.1.454.CMB.1.raw
  modified_base (258)..(258): a, c, t, g, unknown or other
  misc_feature (258)..(258): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctgggggtccctgagactctcctgtgccatgtctgcgtctgaattcatcctcaggcactatggcatgcacgtgggtcccgccgaggcccccaggcgaagggactgggaggtgggtggctattanactaatttgatggaagtaattaaaaaagttttacgacaagactccgtaggaagggacctattccaacctattcctaccaaggaccgtaccccttacccaaaccactaccgcttagtatacctaccaaatacgaaacgagtaggtacgacgtaagttaggaagaacgacggtactaactttaattacgtttagtacggtacgtaaaaggttactttaccgggtttggtacgtagtactaacgttaccgaaagtttgggtagggttaagtaggggggtttacgccgtttaccggaccgtaaccgggttcgggggaccgtaaaggggacctacgggtcggttaccgaccgttcctcccgtaccacgtcccgtaccaccggaaccggtcccacgttccgtacccttccccgtacggtccctacccgttccctaaccgacgaccgccgtacccgg

SEQ ID NO: 44220 - DNA, 860 bp, Homo sapiens
  misc_feature: GYAE6OF02IAW7Z.31.14.B03.1.454.CMB.1.raw
tcagcagtagacgtcacgaccggtgctcgatttagtgtgagtagtttgggctgagctgggttttcctcgttgctcttttaaagaggtgtccagtgtcaggtgcacctggtggaatcgtgggggaggcgtcggtccggccgtcggggggtcctgagactcgtcctgtacgcccattcgtcgtaggccgttctagaacttccaacttcccgtacgacgggtacaacttagtggacctagttcgccacggtcggggtcccaccggaccggaccccgtaggaccaaagggcgtagggacggttggggcgtaactaagtttaactaacgtaacgttttaggagttacgggtaaaagtaaacttttaaaaaagttttccgaacgtaacgttaccgtaccggtaggtaacgggacccttataccgacctacgtactaccgaacgtaccgtacccctaccgaaaccctagtacccggtacttacgttactaccgtaaaccgttaacgtaacgtaacctggttaaggtacgtaaacggtacgttaaagaaacggtaccgtaaacggtacttaaatttaacgtagtttacggtaggtaaacgtaaagttccgtttacgggtttacggtacgtaagtaccgtataaagttacggtaagggttagtacggtttacgggcggtaaccgaccggtacgtacgggtacgggaacgtaagggacccgttcggtacgtacccgtacccgttactcccgttaaccgccgtttaccccgacctaaacccggtaccggtcggttaaccggtccccgtcccgttaccccggtcgtaccccgttcctaacccgtacggacgtacccggtccctaaaccgggg

SEQ ID NO: 44221 - DNA, 878 bp, Homo sapiens
  misc_feature: GYAE6OF02JAZZM.31.14.B03.1.454.CMB.1.raw
tcagcagtagacgtcacgaccggtgctcgatttagtgtgagtagtttgggctgagctgggttttcctcgtttgctcttttaagaggtgtccagtgtcaggtgcacctggtggaatcgtgggggaggcgtggtccggcctggggggtccctgagctctcctgtgccatgtctggcgtctgaattcatcctcaggcactatggctatgcacgtgggtcccgccacggccccaggacgaacgggacgtgggaggtgggtcggactagttttaataactaagtttcgaagttaggtaaaggtaaatttaaaaaaacgtttttaccggactaagaaccccggttccggttaagggaaacggggtaccctaattttacccaaaccctactttacccgtacccaacggtaacccggtaacccccctttaaccccaaaccccgtaacttacccggtaccttaggttaccttaccctaacctaaaacgttacgtaaaacctacgggtttagggtaaacggacttaggtttaaccgggaaacgtaccgtaaccggtaaacttaaacccgtttttagttaacgttttcgaagggtaaccgtaaaaggttttaacgtttcggttgggttaccggacgtaacgtaattacgaaggttcggtaggggttaagtgggtacgggccttaacgggaccctaccgggtcggggaccgaaaggggtaaccgtacgtcggtacccgtaccggtcctcccgtaaccgtatccctacccgtaacccggacggtcccccgttaaccggttcccggtttacccccttaccccccgggtggttaacccccccttacccccggttaccctaacccgggtaagacccccttacccgggtaacggg

SEQ ID NO: 44222 - DNA, 925 bp, Homo sapiens
  misc_feature: GYAE6OF02G26ZE.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtaggaatcgtgggggaggcggtggtccggccgtggggggtccctgagctctcctgtcgccatgtctgcgtctagaattcactcctcaggcactagtggcagtcgcacggtcgggtcccgccgacgggccccgaggacggaaagggtcgtaggggaggtggggtggactattttaactaataatttggaagtaggtaaataaaagtttaaaaaactttcgactaacgtaccgtccggtagggaacggtaccgtacttaccacctactccgtaccgaacggtaacccgtaaccccttacccgaaacctactaccgtcgttagtaacgttaccctaacgtaaacgtacgtaaaccgtaggttacgggtaggaaccttaagggttaaacggaaaccggaacccggtaacccggttaaacttttaaacgttttaacgttttaacggtttagggttacgaaaaccgggttaaacggtttacgggttttcggtttaacgggggttacccgaagtaccgtaataccggttaagggttacggttaagggttacgggttaagggtcggttaacccgtaccggaacccggtaaccgggttccggggggaaccggttaaccggggtaaaccgttacggttaacccggttccccgtaaccggttcccctaccggttaaccccgtaaccgtcccccggtacccggaaaccccggttaaccccggttaccccggtacccgtttacccccgggttccccttcccccggaccccgttaccccttaccccggtaccccgttacccgaacgggttccctaccccgggttaacccggg

SEQ ID NO: 44223 - DNA, 779 bp, Homo sapiens
  misc_feature: GYAE6OF02FR8X5.31.14.B03.1.454.CMB.1.raw
  modified_base (256)..(256): a, c, t, g, unknown or other
  misc_feature (256)..(256): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatctgggggagcgtggtcccggcctggggggtccctgagactcgtcctgtgccatgtctgcgtctgaattcatcctcaggcactatggcatgcacgtgggtccgccgacggccccaggcaagggactggagtgggtgctatttanactaatttgatggagtaattaaaaatttacgacagactccgtaggaaggcgattcacctatctcagacgaccccttcaaccactaacgcctagtactctacctaaatacgtaacagttggtagacgtagttacgaaacgacgtaacgggtactaaactttaagttaagtttacggtagtaaccggtaaaaggtacgtttacgggtttagggttaccgtaggacctaattaccgtaaatggggttaaggtaaggttagggggttacggtccgtaccggtaacgtaacccgggttggggggtaacccgaaacgggggtaaacccgtacccggttacggggttacccgtaacccgggttccttaccccgttaccgtaaccgtacccccttaccccgaacccggttaacggggtacccccctaacggtttcccccgggttacccccttttcccccggtaccgggtaccccctaacccccggttaccccgtaaccccgaaacgggtacccgtacccctaacccccggg

SEQ ID NO: 44224 - DNA, 719 bp, Homo sapiens
  misc_feature: GYAE6OF02FL1IS.31.14.B03.1.454.CMB.1.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctnaggcactatggcatgacacgtgggtccnccaggccccagggcaagggctggagtgggngcatttanacatttgatgganaattaaaaatttcganaagactccgtaggaacggcctagttaccacgatcctcagacgtacccttaccaacatacgctgtactctaccaatagaacagtggnacngttacgacgacgacgtactaacgtttattagtagtagaccggtaaagttntttaccggtttagggttaccgaaggtacgtaacttaccgtaaagttcgggtaggttaaggttacggggttcggaccgttaccgggaactacccggttacggggggaccgtaagggtaacccgacgttaccgggtaccctacccggttccgtacccgtaaccgtaccgtacccgttacccggaaccggtaaccggtcccccgtacggttaccccggttcccgtttaccccccgtagggtacccccttaccccccgtacccgtaacccgaaccgggtacccgttaccccgtaacccgggg

SEQ ID NO: 44225 - DNA, 700 bp, Homo sapiens
  misc_feature: GYAE6OF02HUEWK.31.14.B03.1.454.CMB.1.raw
  modified_base (264)..(264): a, c, t, g, unknown or other
  misc_feature (264)..(264): n is a, c, g, or t
  modified_base (648)..(648): a, c, t, g, unknown or other
  misc_feature (648)..(648): n is a, c, g, or t
tcagcagtagacgtcacgaccggtgctcgatttagtgtgagtagtttgggctgagctgggttttcctcgttgctcttttaagaggtgtccagtggtcaggtgcacctggtggaatctggggaggcgtggtccggcctggggggtccctgagactctacctgtagccatgtctgcgtctgaattcatctcagcactatcggcatcgcactgggtcctaccaagggccccagggtacaagggtctgggacgtgggtagctagttanacgtatttgatcggagtaataaaaacgtttcgctagactccgtagaacgggtccatttccaaccattctaccaggtaactaccccttaccaaccactaccgctacgtactcctacaaacgtacaacagttgggacacgtaaggttgaacgaccgacggtactaacttatttacgtgtacgtagaaactagttcgttagtcgagacatacaagtgtagggattagggcggttactaccgacgtacccggtaggggtaccgaacgggtaaccacggttacgggtaccttaacccgggtcccttccgtaaccgtaccgtacccgtaccctaaacccgggtaccggggtacccctaaccgggttccccggttaccttttaccccccgnggaccccgttaccctaccccggttaacccaacggtacaccccgtaacccggg

SEQ ID NO: 44226 - DNA, 888 bp, Homo sapiens
  misc_feature: GYAE6OF02F5W92.31.14.B03.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggctgagctgggtttcctcgttgctctttaagaggtgtccagtgtcaggtgcacctggtggaatctgggggaggcgtggtccggcctggggggtccctgagactctcctgtgccatgtctgcgtctgaattcatcctnaggcactatggcattgcacgtcgggtcccgccagggcccccaggtaccgaacgggtactgggacggtgggggtcggtacctattttagacgttaattttcggagttagggaacgtaaagtttaaaaaaacgtttttaccggactaacggtaccgttcccggtaggaaacgggggtaccccgtaagtttaccctaacccgtaactttcccgtacccgtaacggtaacccgtaaacccccgttttacccaaaaaccccgtaagttaacccggacctttacgttaacttacccgttaacccctaaaagtttcaaaccgtagttcgggtacggtaacgtaacggtttacgaaaccggtaccgaacggtaaccttaaactttaacgttacgttaggtacggtaccgtaaaagttacgttttaccggtgggtttacgaggtacctaacttacgtaaacgttgggtaaggtaacgggttggggttacggtacccgtacgggtaacccgtacccgggttacggggacccgaacggggtaaactaccgtttacgggacccttacccgttcctcccggtaacgtaccgtccccgtacccgaacccggtaacgggtccccctaacggtttccccggtaccccttacccccggtaccggttaccctacccccgttaccccgtaaccgaacggtacccgtaccgttaaccccggg

SEQ ID NO: 44227 - DNA, 910 bp, Homo sapiens
  misc_feature: GYAE6OF02I02IQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtcgcacctggtggaatcgtgggggagcgtggtccggccgtgggggtccctagagactctcctgtcgccatgtctgcgtctagaattcactcctcgaggcactagtggctactcggcacgtcgggtccgaccgacgggcccgaggtaccgaaaggggtaccgtaggggtacggtcgggggtacgacttaacgtttaactaacgttaacgtttcgaagttagggtaaacgttaaaaatttaaaaaaaaccggttttccgaacgtaaccggtaccgttaccggttaaggaaaccggggtccgtaacgtttacccaaccgtacgttcctaccgaagtacccgtaaccccttaccaaacgtacgtaccgtacttacgtactacctaccgtaaaacgtcgtaaactacgttacgggtacgtaacgtaagggtttaacgaaaacgtaaccgaacggtaaccttaaacgttttaaccgttaagttttcggggtaacctaacgggtaaaaacgttttcgggtttaccgggttttaacgggttaaccgtaacggttacttaacggttaacgtaagggttacggttagggttaaaccgggttaggggttaccgtaaccgtacccggttaaccgggtacccggggttacgggggaaaccgtaaccgggtaaaccgtacgggttaaccggttaccctaccccggttaccttacccggtaccgaacccgttacccgtaccgaaccgtaccggggtaaccctcgggttaccttaccccgtcccgtacggtacctccccttagaacccggactaccgtacggtcccg

SEQ ID NO: 44228 - DNA, 827 bp, Homo sapiens
  misc_feature: GYAE6OF02F68MI.31.14.B03.1.454.CMB.1.raw
tcagcagtagacgtcacgaccggtgctcgatttagtgtgagtagtttgggcgtgagctgggttttcctcgttgctcttttaagaggtgtccagtgtcaggtgcacctggtggaatctgggggagcgtggtccggcctggggggtccctgagactctcctgtgccatgtctgcgtctgaattcatccgtcgaggcactgtcggcatcgcgtacgtcgggtcccgccaccggccccagggaccaaggggtactcggggaggttgggtaggccttaagttttaactacgtaacgttttggaagtaggtaagtaaaacgtttaaaaaacgttttaccggactaacggtaacccgttcccggtagggtaaacggggtaccctaactttacccgaaccctacgttccctacccgtaaggtaaccccgtaaccccctttaacccgaaccctacgttaacccgtcgttacgtaacgttacccttaaccgtaaacttacgtaaacgtacgttagggttaacgaaacgtttacgggttagtaaaccggaacgtaaccgtaaccttaaaccgtttagttaacgtttaggaacgtaacgtaaaacgttcgttttacgggttcggttacggacgtcgtaattacgtaaagtcggtaggttaggtaggttcgtacgtacgaccgtcgggtacggacgtaagggtacctacggtcgttccgaccgttaccgtccgtaccaccgtacccgtacccgacggtacccggtaccctcggttaccccggttccctaccccgtaccgttacccctacccgtcccgtaacgacggtacctcccgtaccg

SEQ ID NO: 44229 - DNA, 946 bp, Homo sapiens
  misc_feature: GYAE6OF02IZ3BN.31.14.B03.1.454.CMB.1.raw
tcagcagtagacgtcacgaccggtgctcgatttagtgtgagtagtttgggctgagctgggttttccttcgttgcttcttttaagtaggtgtccagtgtcaggtgcacctggtggaatcgtggggggaggccggtgggtccgggccgtggggggtcccgtgagacctctccgtgtgccagtgtctggcgtctagtaatttcactcctcgaacggctactagtggacagtgccgtaggtcgggtcccaccggaacggccccgaggacgaagggtcgtgggtagggtcggggtggacgttaattttacaattaacgtttaggaggttaggtaaataaaagttaaaaaacgttttaccgactaacgtaacgtccgggttaggaaaccgggtaccgtacttaccgaacctacctaccgtaccgtaacggaaccccgttaaccccgtaacctaaacctaaaccgttaaccgtccgtttacggttaactccgtaaaaccgttaaaagtacgaaacgttaacgggttacgggtaacgtacggtttaaacggtaaggtaaaccggaacccgtaaacggggttaaacttaaaacgtttaaacggttttaaggtttaacgggttaacgtaaacgggtaaaacgttttacgggttttaacgggtttaacggggtttacgaaccggttacggtaaacttaacggtaaggttagggttaagggaacggggttcgggttaccggtacgtaccggaaacggtacccgggtacggggaaccggttaacgggtaaccggtagttacccgggtaccgtaacccgttctacccgtaccgtaaccggcccttaccgaacccgggtaaacggtcccgttaaccggtttaccccgggtcccccttttaccccggaccgttccccctaacccgttaccgtaaccggtaacccgaccggtcctaacccggg

SEQ ID NO: 44230 - DNA, 809 bp, Homo sapiens
  misc_feature: GYAE6OF02JQVOW.31.14.B03.1.454.CMB.1.raw
  modified_base (185)..(185): a, c, t, g, unknown or other
  misc_feature (185)..(185): n is a, c, g, or t
tcagcagtagacgtcacgaccggtgctcgatttagtgtgagtagtttggctgagctggtttcctcgttgctctttaagaggtgtccagtgtcaggtgcaccgtggtggaatcgtggggagcgtggtccgcgtgggggtccctgagtactctcctgtgcctatgtcctgcgtctgtaattcatccnacggctactagtggactagtgtcctacggtcggtccaccgtacggacccagggtacgaaaccgggacgttagggacggttacgggtcgtacctaagtttaataccgtaagtttaggagttaggtaaagtaaaacttaaaaaacgttttcggacgtaacgtaccctacggtaacggaacggccgttacttaccggaacctacttacgaccgaagtcccgtaaccctaccaaaccgtagtaccggtactaggttatacccgtaataaacgtggtaaaccctagttgggaaccaacggttacgtaaggtaacgtaccgtaacggttaaccttaaacgtttacgtacgtttcgtaacggtaaccggttaaaagttccgtttaacggggttcgttaacccggaatacgttaacgttataacggttgtaagggttacggttaacggggtcgttccgaaccgtaaacggttcccgggacggtaccggtaacgtaccgtacgtacggtccgtacccgtaccgtcctcaccgtaccgtaccgaacgtaccggtcccttaacggtccgttcccccgttacccggacgtccccgtaccctccgttaaccgaacccggtacgtaacccgtcccggg

SEQ ID NO: 44231 - DNA, 800 bp, Homo sapiens
  misc_feature: GYAE6OF02JGSOM.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctagaattcatcctcaggcactgtggcatgctacgtgggtcccnccgacggccccaggtaccgaagggacgtgggagtgggtgactatttacaactatttagagtaggtaagaaattaaaaaacttttacggacgtaagtaaccgtccggttagggaaacgggcccggtaattaccgaacccacgttcctacccgaagaacccgtaccccgttacccaaacccacgtaaccgtacttacggtactacctaaccaaattacggaacctagttcgggtaacgacgtagttacggaacgaacgaccggtaactaacgtttatttagtgttacggaaccgtaaattacgtttacggttagggtttacggaacgtctaacgttaactaagtgggttaaggaggttaggggtctaccggtaccgtaaccgccggttaccggggaacgtacgggaaccgttacgtacgggttcccgtaacgttcccgtaccgttaccgaccgttaccccacccgtaaccggtaaccgggtccccgtaaccgttcccgggttcccccctttacccccggtcggttacccccgtacccccgttaccccgttacccgggaaaccggtaccgcccggttaaccccggg

SEQ ID NO: 44232 - DNA, 777 bp, Homo sapiens
  misc_feature: GYAE6OF02GPPZP.31.14.B03.1.454.CMB.1.raw
  modified_base (281)..(281): a, c, t, g, unknown or other
  misc_feature (281)..(281): n is a, c, g, or t
  modified_base (664)..(664): a, c, t, g, unknown or other
  misc_feature (664)..(664): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggagcgtggtccggcctgggggtccctgagactctcctgtgccatgtctagcgtctagaattcattcctcaggctactagtggcaagtcgcaacgtcggggtccaccgacgggcccccagggacaaacgggtctagggtaggtgggtcggactagttttaanaacgtaatttgagtaggaacgtaaattaaaaaaagtttcgaacgtagaccgttacggtagggaaacggaccgtaacttaccgaacctacgtcttaccgaaggaccgtaaccccttccaaaccagttaaccgcgttaagtctaccgtaactaaatacggaactaagttcggacgtaaatggttaacgaaagtaacccgaaggtacttaaactttaaagttacgttagtaggaacgtaaaaagtcgtttacggttaggtaccggtagaaccttaagtaccgttaaagtgggttaacggtaacggttggggttacgcccgttaagacccgtaccgggttcgggaacggtaaaccggtacgtacgtacgggtacctaaccgggttcncccgtttaagacccgaccttacccggaaacgtaccgggccccttaacggtcccggttacccttccccgtaggcccctttaccccaacgtccgaacggcctacccgtacccggg

SEQ ID NO: 44233 - DNA, 1016 bp, Homo sapiens
  misc_feature: GYAE6OF02JLLMF.31.14.B03.1.454.CMB.1.raw
  modified_base (184)..(184): a, c, t, g, unknown or other
  misc_feature (184)..(184): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctggggagcgtggtccggcctggggggtcctgagactctcctgtgccatgctgcgtctgaattcatcctnaggcactagtggcatgcacgtcgggtccgccgacggccccgaggacgaagggactagggaggtgggtcggctagtttactacgtaatttgagtggtaagtaaattaaaaagttttacgactacgacgtaccggtaggaacgggtcccgtaagttacacctacgttccgtacccgtaggtaaccgtacccccgtttaccgaaaacccttaacgtacgtaccgttacggttaaccttaccttaaccgtaaaggtacgtaaaacgtacggttacggggtagtaacggtaacggtttacgggaaacggtaacccggtaaacgggtaacccgttaaaaccgtttttaacgttttaacggtttacggttaaacgggtaaccgggttaaaaaacggtttacggtttttaaacccggggtttttacggggttaacccgggttaaccggttaaccgtaaacgtttaaacccggtttaaaaggttcgggtttaaagggggttaaccgggtttaacggggggttaccgggttaacccgggttacccgggtaacccgtaaacccgggggttaaccggggggaacccgggtaaaaccggggttaaccgttttaaccgggtaccggggttaaacccccgttaccccgggttacccttcccccggtttacgaaccccggttacccccgttaaccccggtaaccgggtacccggggtaacccccggtttaaccggtttccccggggtttaaccccctttacccccgggttacccggtaaacccccgtttcccccggttaaccccggtaaccccgtaaacgggtaccccggttacccggttaccccggg

SEQ ID NO: 44234 - DNA, 820 bp, Homo sapiens
  misc_feature: GYAE6OF02FO4EE.31.14.B03.1.454.CMB.1.raw
  modified_base (262)..(262): a, c, t, g, unknown or other
  misc_feature (262)..(262): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggcctggggggtccctgagactctcctgtgccatgtctgcgtctgaattcatcctcgaggcactatggcatgcacgtcgggtcccgccgacggccccaggcgaagggactgggagtgggtgactatttanactaagtttgagtaggaagtaaattaaaaaacgttttcgactaacgtaccgttccggtaggaacgggtccgtaactttaccgaaccgtaacgttccgttaccgaacgtaaccgtaacccccgtttaccaaaccgtacgttaaccgtacgttacggttacttaccttaaccgaaaagttacgaaacctaggtacgggtacgtaacgtaaggttacgaaacgtaaccgtaacggtacttaaacgttttagtttacgttacggtaggtaaccgttaaaaggttacgttttcgggtttaggttacgtacgtactaacgtacgtaagttcgggtaaggttaggtacggggtacggtccttaacggaaccgtaccgggtacggggaccgtaaacgggaccgtacggttacggtacccgtaacccgttccttacccgtaccgaccgtaccccgtaccgaaccggtacccgggtaccctaacggttccccggttcccccgtttaccccggtacggtacccctaccccttaccccggtaacccgaacggtcccgtaccctaaccggg

SEQ ID NO: 44235 - DNA, 875 bp, Homo sapiens
  misc_feature: GYAE6OF02G79EL.31.14.B03.1.454.CMB.1.raw
tcagcagtagacgtcacgaccggtgctcgatttagtgtgagtagtttgggctggagctgggttttccctcgttgctcttttaagaggtgtccagtgtcaggtgcacctggtggaatcgtgggggaggcgtgggtcccggccgtcggggggtccctggagtactctcctgtcgccattgtctgcgtctagacttcactcctgacggctacgtatcggactagtcggccgtacgggttccggggtcccgacccgaccgggaccccggagggaccggaaaggggtcctagggggtaggttggggtcggtacttaacgttttataaccgttaatttggaacgttagggtaaagttaaaactttaaaaaacgttttcggacaacgtacgtacggtaaggaaccgggtaccgtattacccgaacctacgttaccgtaaccgtaaggtaaccccgtacccttaacccgaaaaccgtctaaccggtacgttccgttaactaccctaaacgaaacgtaacgtaaacgtcggttaggtacgtaaccggttagttaaacggaaacggtaacccgtacggtaaacctttaaaccggttatttaacgggttacgttaacgggaacggttaaaacgttacggttttcgggtttaggtaccgtaataccgtacgtagtaacggtcggtaggttaacgggtacgggttcggtaaccgtacggtaacccgacgggtacgggacccggtaacggtaaccgtccggttcgaccgttacccgtccttaccgccgtcgtaccgtacccgaacggtacccggtccctacggttccccggttaccgtacccccgtaggtccccctaccgtaccctacgaaccgttccggcttacccgg

SEQ ID NO: 44236 - DNA, 773 bp, Homo sapiens
  misc_feature: GYAE6OF02FUZU2.31.14.B03.1.454.CMB.1.raw
  modified_base (255)..(255): a, c, t, g, unknown or other
  misc_feature (255)..(255): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatcgcacgtcgggtccgccgacggccccagggacgaagggacgtggaggtgggnggctatttatactaagtttgagtaggagtaaattaaaaaagttttacgactaacgacgtaccggtaggaacgggtccgtacttccacctatcctaccgacggaaccgtaccccttaccaaccctaactacgaccgttgtactacctacctaaagtacgaactagtaggtacgtaacgtagttacgaaacggactaacggtaactaacgtttaatttacgttagtcgtaacggtaaacgtacgttttacggttaggttcggagtactacgttactaagttcgggtaggtaagttggggtacggttaccgtaccgggaccgttaccggggtacggggacccggtaaggggtaacccgtacggtttaccggtacccttaccccgggttcctccccgtagacccgtcccgtaccccgtaaccggacccgggttccctaaccgggttccccgttaccccgttcccccgtacggtacccctaccccgtaccccttacggaaccgttacccgaccgttacccggg

SEQ ID NO: 44237 - DNA, 965 bp, Homo sapiens
  misc_feature: GYAE6OF02GAE5J.31.14.B03.1.454.CMB.1.raw
  modified_base (266)..(266): a, c, t, g, unknown or other
  misc_feature (266)..(266): n is a, c, g, or t
tcagcagtagacgtcacgaccggtgctcgatttagtgtgagtagtttgggctgagctgggttttcctcgttgctcttttaagagtgtccagtgtcaggtgcacctggtgaatcgtgggggagcgtggtccggccgtgggggtccctgagactctcctgtgccatgtctgcgtctagacttcactcctacaggcactatcggcatcgcacgtggggacccgccaccggccccgaggacgaacgggaccgtgggacggttgggtcggntaagtttactaacgtaatttgaagtaggaagtaaaactttaaaaaacgtttttaccggactaaccgtaccgttacccggtagggtaaaccggggtcctaacgttacccaacctacgttacctacccgagtaacccgtaccccttacccaaaccctacgtaccgtcttacgtaaccgttcctaacctaaagttacgaacgtaggttacggtaacgtaacgaacgttaacggaacggttaaccggaaccggtaactttaaacgttttaacgtttaacggtttacggttaacggaacgtttaaaacggtttacgtttttaacgggggtttttacgggttacccgggttaagaaacccttaagttaaacccgttaaaggggttaggggtttaaccggggaaacggggttttaaccggggggttccgtaacccggggtttaaccggtaacccggtttaacccggggttacgggggaacccggaaaccgggggtttaaccaccgggtttaccgggttaacccccgtaacccggttcccccttaccgcccggtaacccccggtaccccgtacccggtaaccccgggtaaacccgggtcccctaacccggggttcccccgttttaccccccgttaccccggttacccgacccccgtttacccctacccggttaaccccgaacgttacccgaccccgtttaccccggg

SEQ ID NO: 44238 - DNA, 684 bp, Homo sapiens
  misc_feature: GYAE6OF02H9PHE.31.14.B03.1.454.CMB.1.raw
  modified_base (217)..(217): a, c, t, g, unknown or other
  misc_feature (217)..(217): n is a, c, g, or t
  modified_base (590)..(590): a, c, t, g, unknown or other
  misc_feature (590)..(590): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcgaggcactatggcatgcacgtcgggtccnccgaggccccaggcgaagggtactggagtgggtgctatttatactatttgagtaggataaattaaaaattttacgacagtaccgtaccggtaggaacgggcctattaccaacctatcctaccgaagaccgtaaccccttaccaaccactacgcttagtactcctaaccgaaatagaaacgtgttagggcgaacgtaaggttagaaacgtacgaccggtacctaacgtttaactttagtttggtagaacgtaaacgttacgtttcggttggttacgagctaattacgaagtggtaggtacgttagggtcggtactaccggacgtaccgggtgggaccgaacgggtaactacgtacggttccgaccttcctaccncgtaccgtcctaccgaccgacgggtcccacgttccggtacccctccccggtacgccctaccccgttacccgacgaccggtacgcccgttaccgg

SEQ ID NO: 44239 - DNA, 634 bp, Homo sapiens
  misc_feature: GYAE6OF02FP8U9.31.14.B03.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (444)..(444): a, c, t, g, unknown or other
  misc_feature (444)..(444): n is a, c, g, or t
  modified_base (545)..(545): a, c, t, g, unknown or other
  misc_feature (545)..(545): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccncaggccccaggcaagggctggagtgggtgctagtttanacaatttgataggagaattaaaaaatttacgacagactccggtagaacgggccgattccaccatcctaccagacgaccccttaccaacctatacgctgtactactaccaaatgaactataggtgaactagttagaagacacggactaacttattattgtagtacgtaaaagtgtttcgtttagtacggtanactagtactaagtggtagttagtagggtacgtacgtacgaccgtaccgggtcgggtaaccgacgggtaaccacgttcggaccctaccgttccctcgtaccncgtaccctacgaaccgaccgggtccctaggtcccgttaccccgtccctcggacccctccccgttaccacctaaggtaccgcctacccgg

SEQ ID NO: 44240 - DNA, 783 bp, Homo sapiens
  misc_feature: GYAE6OF02I8MUT.31.14.B03.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaacttcatccgtcacggcactatggccatggcactcgggtccnccagggccccaggccaagggtactggagtgggtgactatttaanactaatttgatcggatataaaaaagttttcacagactacgtgtaacggaccgtattacaccgaatcctactacggacacccgttccaaaacccagtaaccgtcttagtacttaccgtaccctaaaagttcgaaacctaagtacgggtaacgaccaacggtttagaaacgtaaccgaccggggtacctaaactttaacgtttaactttaaggtacgaaccgtaaaaacggtacgtttaccggttttaaggtttccgaaggtacgtacttaccaattacggtaggtagttaagggtcggtaccgtaccgtacgtaacccggtagggtacccgaagggtaaaccgtacgttaaccggtcgtaacccggtttccgtccctacgtacgtacccgttacccgaaccgtaaaccggggcccgtacgttacccggggttacccctttaccccccggttacgggtacccctaaccccggtttaaccccttaaccccggaaggtacccggttaccccgttaaaccccgg

SEQ ID NO: 44241 - DNA, 886 bp, Homo sapiens
  misc_feature: GYAE6OF02GFY7H.31.14.B03.1.454.CMB.1.raw
  modified_base (219)..(219): a, c, t, g, unknown or other
  misc_feature (219)..(219): n is a, c, g, or t
tcagcagtagacgtcacgaccggtgctcgatttagtgtgagtagtttgggctgagctgggttttcctcgttgctcttttaagaggtgtccagtgtcaggtgcacctggtgaatctggggagagtggtccggccgtggggggtccctgagactctcctgtgccagtgtctgcgtctagaattcactcctcaggcactagtggcatgcacgtcgggtcccnccgacggccccgaggacgaagggacgtgggaggttcgggtgacttagtttaataactaagttttgagtaggaaacgttaaattaaaaaagttttccgactacgtaccgtaccggtaggaacgggtcctagttaccaacctactcctaccgagtaaccgaaccccctttacccgaaacctatacccgtacttcgtaactaccgtaactaaacgtacgaaactagttgggtacgaacgttaaggttacgaaacggtaccgaacggtaacttaaacgttttagttaagttagtacggaagtaaacggtttagtttcgggttttaacggtacggataccgttaataacgtaaggttcggttaaggttaacgggtacggggttcggtccgtaaccgtaaccggtccggggtaccggggtaaccggaacgggtaaccgtaaccggtttaccggggtacccttaaccccggtttcccgttacccgtaacccgtaaccccggttaccccgttaacccccggtaacccggtaacccccggggttcccgtttaaaccccgggttcccccggttttccccccggtttacccccccgtccggttaaccccccttaccccccggttaaccccgttaacccggtaaacccggtacccgttaacccccgttaacccccgggg

SEQ ID NO: 44242 - DNA, 897 bp, Homo sapiens
  misc_feature: GYAE6OF02FQNOX.31.14.B03.1.454.CMB.1.raw
  modified_base (224)..(224): a, c, t, g, unknown or other
  misc_feature (224)..(224): n is a, c, g, or t
tcagcagtagacgtcacgaccggtgctcgatttagtgtgagtagtttgggctgagctgggtttcctcgttgctcttttaagaggtgtccagtgtcaggtgcacctggtggaatcgtggggagcgtggtccggcctgggggtccctgagactctcctgtcgccatgtctgcgtctgaattcatcctgacggctactatcggactatcgacgacgttcgggtcccnccgtacggccccgagggtaccgaaagggtaccgtgggaggttggggtcggactaacgttttactaacctaaagttttagaaggttacggtaaacgtaaaatttaaaaaacgttttacgacgtacgtaccgtccggtaggaacggtccgtacgttacaccgtactccgtacctaacgtaccgtacccctacctaacccgtaagtaccgtaccgtttacgtaacgttaccctaaaaccgtaagtacgtaaacctacggtacggttaaccgaaccggtaaggtttaacgggaaaccgaaccgtaacgggtaaacctttaacgtttaagttttaacgtcggtacggaactaaaaggttcgttttccgggttacgggtaacgtagtctaaacgttactaacgttagggacggttagtagggggttacgaccgttaccggtacccgtaccgggtaggggtaacccgaaagggtaccgtacggtttacccgggtaccctacccggttaccgttacccgtcccggtaaccgttccccgtaccccgtaacccgggaaccccgggttccctaacccggggtttcccccggttacccccgtttccccccggttaccggtacccccttaccccccgttaccccggtaaacccgtaaccggacccggtttaccccaacccccgggg

SEQ ID NO: 44243 - DNA, 776 bp, Homo sapiens
  misc_feature: GYAE6OF02HY8PC.31.14.B03.1.454.CMB.1.raw
  modified_base (223)..(223): a, c, t, g, unknown or other
  misc_feature (223)..(223): n is a, c, g, or t
tcagcagtagacgtcacgaccggtgctcgatttagtgtgagtagtttgggctgagcgtggttttcctcgttgctcttttaagaggtgtccagtgtcaggtgcacctggtggaatcgtgggggagcgtggtccggccgtggggggtcctgacgactctcctgtgccatgtctgcgtctgaattcactcctcgaggctacgtatggacagtgcacgttcgggccnccgtaacggccccgaaggaccgtaagggactagggtacgggtgggtagtcttaattttaacgaacgttaagtttggtagtaggtaaagttaaaaactttaaaaaaacgttttaccgaccgtaaagtaccgtaccggtaaggaaacgggtccgtaactttaccgaactacttccgtaccgaaggtaacccgtaccccttaaccaaaccgtacgtacgtacttggtaactacctactaaatcgaaactcgtaggtacacgtacgtaacgaagacgaacgtacttaacttattagtagtacgaagtaaagttcgttacggttcggtacgagtactaaatcgtaaagtgggttacgtaacggttcggtaggtcccgttaaacgacgtaccgggtacgggaaccgacgggtaaacgtcgtcggtaccgtccgttaccgccgtaccgaccgacccccgacggaacccgggtccctaacccggttcccggttacccgtcccccggttacgaccccgttaacccgcccgtaccgaaaccgtccgacccgtccgtaccgggg

SEQ ID NO: 44244 - DNA, 773 bp, Homo sapiens
  misc_feature: GYAE6OF02FJE8H.31.14.B03.1.454.CMB.1.raw
  modified_base (271)..(271): a, c, t, g, unknown or other
  misc_feature (271)..(271): n is a, c, g, or t
tcagcagtagacgtcacgaccggtgctcgatttagtgtgagtagtttgggctgagctgggttttcctcgttgctcttttaagaggtgtccagtgtcaggtgcactggtggatctgggggagcgtggtccggcctggggggtccctgagactctcctggtgccatgtctgcgtctgaattcatcctcaggcactatggtcatgcacgtcgggtcccgccgacggccccgagggacgaacggggactgggacggtgggtaggactattttaanactaatttgataggaagtaaattaaaaattacgactacgactccggtaaggacgggtaccgtattaccgaccaactccgtaccagtaccgaccccgttaccaaacacgtacgtccttagtaacttacctaacctaaagttacaactgtacggttagtaacgtaggttaacgaaacgacgaacccggtaacttttaagttacgtttacgttacgtacggaaacgttaaacggtttcgttttacgggtttacggtaaccgtagtactaacgttacgtaaaggttcgggtagggtacggttaaggggtcggtccgttaacgaccgtacccggggtagggtaaccggtaacgggtacttacccggtgggttaacccttacccgtcccgtacttccgaccgtccccgaccgaaccgtacccgggtcccttaacgggttccccttaccccgttcccgttacgaccccgttcccgttaacccgacggtacgaccgtacccttaacccgg

SEQ ID NO: 44245 - DNA, 767 bp, Homo sapiens
  misc_feature: GYAE6OF02GBF3H.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcctggggggtccctgagactctcctgtgccatgtctgcgtctgaattcatcctcaggcactatggcatgcacgtgggtccgccgacggccccgaggaccgaagggtcgtgggaggtgggtggactaagtttactaacgtaagtttgagtaggtaagtaaaactttaaaaaacgttttcgactaaggtaaccgtaccggtagggtaacgggaccgtaagttcccaaccgtagtcctaccgaagtaccgtaccccttacccaaacctacgtaccgacttcgtaactacctaaccaaagtagaaactagttggacgtaacgtagttacgaaacgacgacgtaactaaacgtttagttacttaggtagtaacgtaaagttcgttacgggtttgtacggtaacgtactaagttacgtaagtcgggtaggtaacggttgggtacggtaccgtaacgaccggtaccgggtcggggtaaccgaagggaacccgtacgtcgggtaccctaccgtccctaccgtcgaccgtccctaccgaccggtaccggtccccgtaacgtttccccgggtaccccttccccggcgtacccccgttacccgtacccccgtaccgaaccggtaccgtacccgttaacccggg

SEQ ID NO: 44246 - DNA, 597 bp, Homo sapiens
  misc_feature: GYAE6OF02HPNTZ.31.14.B03.1.454.CMB.1.raw
  modified_base (264)..(264): a, c, t, g, unknown or other
  misc_feature (264)..(264): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcatcctcaggcactatggcatgcacgtgggtccgccacgggccccaggcaaggggacctgggaggtggggtaggctaattttanactaattttggatggaagtaattaaaaaatttacgcagactccggtgaagggccatcaccatctccagacgtacccttaccaacctatacgctgtactctaccaaatcgaactagtggtgactaggttagaagacgacggactaaacttagttattgtagacgtaaagtattcggttggttcgagtcatctaagtggtaggtagtaggggtcgcgtcgactaccggtggggccgaagggaactcgtggtctaccgtctcncacgccnccacgaccggccctacgtccggtcctccccgtggccctaccctccgaccgaacgtcgacctaccgg

SEQ ID NO: 44247 - DNA, 900 bp, Homo sapiens
  misc_feature: GYAE6OF02GWNLP.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggccgtgggggtccctgagactctcctgtgccatgtctgcgttctgaattcatccctcaggcacttagtcggcatgcacgtcgggtcccgaccgacggccccgaaggacgaagggtactgggaggtggggtcggacttaatttagtaactaagtttgagttaggtaaagtaaaatttaaaaaacgtttttacgacgtaacggtaacccgttaccggttaagggaaccggggacccggttaactttaccaacccctattaccgttacccgaacgtaacccgtacccccttaaccgaaacccgtaattaacccggtcttaccggttaactacccttaaccgtaaaacttacggtaaaacctagggtttacgggtaacgtaaccggttaaggttaacggaaacggtacccgtaaccgggttaccttaaaacgttttatttacgtttacggtaaggtaaccggtaaagtttacggtttcggtttacgggttacgaacgttctaacgtactaaggttggtaacggtaaggttcggggttacgaccgtacgggtaaccgtaccgggtaccgggggaccgtaacggggaaccgttaccgttaccgggtaccctacccggttcccttacccggaccgttaccgtcccccgtacccggaaccggtaacccgggtccccgttaccggttccccgggttcccccgttacccccgtaccgggtacccccttacccccggtacccttacccggaacggttacccggccccttaaccccgggg

SEQ ID NO: 44248 - DNA, 850 bp, Homo sapiens
  misc_feature: GYAE6OF02HAIK2.31.14.B03.1.454.CMB.1.raw
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagcagtagacgtcacgaccggtgctcgatttagtgtgagtagtttgggctgagctgggttttcctcgttgtctctttaagaggtgtccagtgtcgaggtgcacctggtggaatcgtgggggaggcggtggtccggccgtggggggtcccgtgagactctcctgtgtccatgtctggcgtcgtgtaattcactcctcgacggaccactatggcagtgccacttcgggcccgaccgaccggccccgagggcgaaacgggggtacgtagggaggtgggggttccggngttaagttttaactaccgttaatttggtagtaagggaagtaaacttaaaaaaattttaccgganaagtccgtacggtggaaacgggccgtaacttccgtaccctatacccgtacacggtaactacccctacaacctaacgtaccgtacgttcgtaactcctaaccgtaaataccgtaaatacgtaggttacgacgtaggttaaggaacgacgtacggaaccaacgtttaattaagttccgaagacgtaagtacgttgtttacgggttacgtagtaactacgttacgtagttaggtacggtaaggtaccggggttgtccggttaccgaccggtaccgggttacgggacccggtaacgggaaccgggtacctaacgggttacccgtaccggttaccccgttaccgtacccgtacgtccccgtacccggtaaacccggtacccgggaaccccggtaccggttcccggtaaccccccggttacccccgttacccggggttacccccctttaaccccccgaacccggtttccccgaaaacccggacggtaacccccgttaacccccggg

SEQ ID NO: 44249 - DNA, 737 bp, Homo sapiens
  misc_feature: GYAE6OF02JBSNV.31.14.B03.1.454.CMB.1.raw
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
tcagcagtagacgtcacgaccggtgctcgatttagtgtgagtagtttgggctgagctgggtttttcctcgttgctcttttaagaggtgtccagtgtcaggtgcaccgtggtggaatcgtgggggaggcgtggtccggccgtgggggtccctggagactctcctgtgccatgtcgtcgcgttctagtaactttcactcctcgagctactagtcggcaatcggcacgtgggtcccncgacgccccgaggacgaacgggacgtaggacggtgggtaggactaagttttanactaagtttgagtaggaagtaaacttaaaaaatttaccggaacgtaagtaacccgtacggtaaggaacggaccgtaacttacgaacctactaccgtaacctaaggtaacccgtaaccccttaacccgaaaaccgtactaaccggttacgtaacgttaactacctaacctaattacaagtacggtagtacacgtagtacggaacgaacgtacgtaactaacttaagttagtttacgagtacgtaaagttacgtttgttaggtacgacgtactcgtaactaaggtaggtaggtaagtcgggttacgccgttacgacccgtacgggcggtaaccggacgaacgacgttaccgtcgacccgttctccgtaacgccgacccgtacaccggaccggtccgtacgttccgtaccctcccgtaccgaccctaccgccgtaacggactacaccgtaccg

SEQ ID NO: 44250 - DNA, 893 bp, Homo sapiens
  misc_feature: GYAE6OF02GJSB8.31.14.B03.1.454.CMB.1.raw
  modified_base (217)..(217): a, c, t, g, unknown or other
  misc_feature (217)..(217): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggagcgtggtccggcctggggggtccctgagactctcctgtgccatgtctgcgtctgaattcattcctcaggcactatggcatgcacgtcgggtcccncgacggccccaggacgaagggactgggtaggtggggtgtctaatttagtactaagttgagtaggaagttaaaattaaacgttcgatacgtacctacggtaggacggtactactacccaaccgtctaccacggaactacccgtaccccgttaccaaccgtactaccgttacgtagttaacctttacccgtaaaactaacgaaccgtaaagttacgggtttaacgggtacgttaaacggtttaacgggtaaacaacccgggtaacccgtaaccgttaaacgtttaaacgtttttcggtttaaggtttacggtaacgggtaaaccggttaagtttaccggtttttacggggttacggtaacccggtaacggttaccttaaggttaaccttagggttagggtaacggggttacggtttagggggtaccgtacgggttaaccccgaccggtaaccccggggttgggggaacccggtaaaccggaccgggttccgttacccgggttacaaccccgtttcccgtacccgttaccggaccccttaccccgacccgggtaaaccgacccggtttaccccgtaccgggtttaccccccgttccccggtttaaccccggacccctaccccggtttacccccgttaaaccccgacggtaaccccggtacggtacccccgggttaccgg

SEQ ID NO: 44251 - DNA, 749 bp, Homo sapiens
  misc_feature: GYAE6OF02HSVB1.31.14.B03.1.454.CMB.1.raw
  modified_base (159)..(159): a, c, t, g, unknown or other
  misc_feature (159)..(159): n is a, c, g, or t
  modified_base (658)..(658): a, c, t, g, unknown or other
  misc_feature (658)..(658): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtgggggaggcgtggtccggcgtgggggtccctgagctctccgngtcgccagtgtctgaccgtctgtaattccattcctcgaaggcctaaacgttgtcggactagtcggactacggtccggggtccccgaccgaccggaccccgtaaggaccgaagggtacgtagggaggttcgggtgtaaccttaagtttactaacgttaagtttggagttaggaaagttaaaacgtttaaaaagtttcgactaacggttaccgtacggaaggaccggtacgtacgttaccacgtcctcgtaactacgaccgtacccctaccgaaactcgtacgtcgtagtaacttccgaaactaacgtacgtaaccgtagtggtaacgtaccgtagttaaacgaagaccgtaccgtaaatttaacgtttagttaagtggtaacgtaacgtaagtacgtttcggttacgtgaacgactagtacaggtgtaggtaagttgggctacctaggaccgtacgggcggaaccggaacgtactcggtcgtaaccgaccggttccaccncgtaccgtacccgaccgtaaccgggacctccgtaccgttaccgtcccctcgccgtaccccaccggttaccacggtactccgacgtcccggg

SEQ ID NO: 44252 - DNA, 733 bp, Homo sapiens
  misc_feature: GYAE6OF02GG4BE.31.14.B03.1.454.CMB.1.raw
  modified_base (257)..(257): a, c, t, g, unknown or other
  misc_feature (257)..(257): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcacgtgggtccgccacggccccaggcaagggactgggagtgggtggctatttanactaattttgatggaagaattaaaaaattttacgcaagactccggtaggaacgggccgattccaccatctaccagacgacccttccaaccatacgctagtactcctacaaatgaacagtcggtgaactagttagaacgacgacggactaaacgtttattatttgagtacgtaaagtntttcggttaggttcgagtcgtataccgtaagttgggtaggtaagttaggggtcggtcccgtaacggtaccgtaacccgggttcgggggacccgtaacgggggaaaccttaccgggttacgggttaccctaaccggttccgtccccttacgaacccgtcccgttaccccgaacccggtaacccggggtccccaaccggtttccccggggtttaccccctttccccccgggtcggtaccccccttacccccgttaccccgttaaccccggaacggttacccggacccccttaaccccgggg

SEQ ID NO: 44253 - DNA, 802 bp, Homo sapiens
  misc_feature: GYAE6OF02GEY7V.31.14.B03.1.454.CMB.1.raw
tcagcagtagacgtcacgaccggtgctcgatttagtgtgagtagtttgggctgagctgggttttcctcgttgctctttaagaggtgtccagtgtcaggtgcacctggtggaatcgtgggggaggcgtggtccggcctggggggtccctgagacctctcctgtcgccatgtctgcgtctgaattcactcctcgaggcactatggcatcgcacgtcgggtccgaccacgggcccaggccgaaggggctggggaggtacgggtcggactagtttactaacgtaattttggaatcggaataaaattaaaaaacgttttcgactacgtacgtcccggtaggaacgggtcctaacgttccaaccacttaccgtaccgaagaccgtaccccttaccaaaccataccgacgtagtactacctaaccgaaatacggaaacctagttacgggtacgaaacgtaggttacgaaaggaccgtaacggtaccttaaatttaacgttagttcgtacggaagtaaagttgttttaccgggttgggtacgaacgtctaagttaccgtaagtggtacggggttaagttacggggtcggtaccgtacggaacccgtaccggggttacggggaacccggaacgggtaaccgtacgttccgggtacctacccgggttacctccgtacggaaccctaccctacccggaacggtacccgggtcccgtaaccggtttccccgggttacccccttacccccggtagtacccccgtacccgttaaccccggttaacccgaaggttaccccgacccgttaaccccggg

SEQ ID NO: 44254 - DNA, 1024 bp, Homo sapiens
  misc_feature: GYAE6OF02HBFKQ.31.14.B03.1.454.CMB.1.raw
tcagcagtagacgtcacgaccggtgctcgatttagtgtgagtagtttgggctgagctgggttttcctcgttgctcttttaagaggtgtccagtgtcaggtgcacctggtggaatcgtgggggagcgtggtccggccgtggggggtccctgagactctcctgtgccatgtctgcgtctagaattcatcctcgaggccaacttagtcgggctaagttcgactaccggtcggggtaccccgccgacgggcccccgagggacgaaacgggacgtgggtaggtcggggttacggtaccttaagttttaataaccgttaagtttggtaacgtagggtaaaggtaaaatttaaaaaaacgtttttccgaccggtaacgtaaccgttacccgggtaaggaaaccgggggtaccgtaaccttttaccgaacccttaacgttccgttaccccgaacgggtaacccgtaacccccttttaaccccgaaaaccccgttaacgttaacccggttaccttacgggttaacctttacccgttaaacccgtaaaaagttaccgtaaaaccgtacggtttaacgggttacgtaaacgtaacggtttaaacgggaaacgtaaccgaacccgggttaaactttaaaaccgttttaacgttttacgtttacggtaacggtaaccggtaaaagggtttaccgttttaccgggttttaggggttaccggtaaagtccgttaaataacgttaacggttagggttacggtaagggttacgggttacgggtaccctaacgggtaccggtaacccgggtcgggggtaaccggtaaccggggtaaacctacggggtaccttacccggtaccccgtttaccgtcccggtaacgtaccccgggtacccctaccggtaacccccggtaacggggtaccccccgtacggtttaccccggttcccccgttaacccccccggttggtacccccccttaacccccggttaccctaaaccccggtaaccggtacccgtaccccggtttaacccccgggg

SEQ ID NO: 44255 - DNA, 598 bp, Homo sapiens
  misc_feature: GYAE6OF02HRIF3.31.14.B03.1.454.CMB.1.raw
  modified_base (217)..(217): a, c, t, g, unknown or other
  misc_feature (217)..(217): n is a, c, g, or t
  modified_base (492)..(492): a, c, t, g, unknown or other
  misc_feature (492)..(492): n is a, c, g, or t
  modified_base (564)..(564): a, c, t, g, unknown or other
  misc_feature (564)..(564): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatctgggggaggcgtggtccggccgtggggggtcctgagactctcctgtgccatgtctgcgtctgaattcatccctcaggcactatggcatgcacgtcgggtccnccacggccccagggcaagggactggagtgggtggctatttataactaatttgagtggaagaaattaaaaaattttacgacaacgacgtaccggtaggaacgggccgtattacaccatccgacctagaccgaaccccttaccaacctataccgtctacgtactacctacaaatgaaacagtggtagacgtagttagaacgacaacgactaatttatattgagagaaactgttcggttgtagatcatcaatgtggagtagggagtctcgacgtcggngggaccaggaccagtcggacaccgttctcctcgacgtccaccaccgacggcccacgtcgtcccttaccccgngtacccaccctcctaccgaacgcgacctacccgg

SEQ ID NO: 44256 - DNA, 874 bp, Homo sapiens
  misc_feature: GYAE6OF02IFWVC.31.14.B03.1.454.CMB.1.raw
  modified_base (778)..(778): a, c, t, g, unknown or other
  misc_feature (778)..(778): n is a, c, g, or t
  modified_base (786)..(786): a, c, t, g, unknown or other
  misc_feature (786)..(786): n is a, c, g, or t
tcagcagtagacgtcacgaccggtgctcgatttagtgtgagtagtttgggctgagctgggttttcctcgttgctcttttaagaggtgtccagtgtacaggtgcacctggtaggaatcgtgggggaggcgtcgggtaccggccggtgggggtaccctggacgacctctcctgtacgcctatcgtcgtgccgtctagtaactttcacttcctagacggacctatacgtcggactagtcgactacggtccgggtcccgaccggtaccgggccccggtaaggaaccggacggggtaaccggtggggtaacggggttgggggtactaacctttaagttttaacctaacggttaaaagttttgtaaacggtaagggttaaaacttaaaaaacgttttaaaaaacgttttccggaacggttaaaccgtacccgttaccgggtaagggtaaccggggtacccttaaacgtttccccaaacccgttacttaccccgtaaccgtaaaccggttaacccctaaccccccttaaaccgtaacccgtaaccggtacgtccgtttaacttaccgtaccttaaccgtaaattacggtaacgtacggtgggtaacgtaccgttaaggtaaacgaacgaccgtaacgtacgtttaactttaaagttgtacggtaaatacggtaacggtttagtttcggttacgggtcaacgttagacttacgaggttacggtaggtaacgtggctaacgccgtacgacggcggaccgtaggctacgtgacccgtacgtccttacnccgtaccnccgaccgtagacccgcgtaccgttcccgtccccgtccgtccgtaaccccttcccggttaccacccggtaagtccccgtaccgtacggg

SEQ ID NO: 44257 - DNA, 817 bp, Homo sapiens
  misc_feature: GYAE6OF02H1286.31.14.B03.1.454.CMB.1.raw
  modified_base (179)..(179): a, c, t, g, unknown or other
  misc_feature (179)..(179): n is a, c, g, or t
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
tcagcagtagacgtcacgaccggtgctcgatttagtgtgagtagtttgggctgagctgggttttcctcgttgctcttttaagaggtgtccagtgtcaggtgcacctggtggaatcgtggggggaggcgtggtccggccgtggggggtccctggagactctcctgtgccatgtctgcgtntgtaattcatcctacaggacactagtggcatcgcacgtgggtcccnccacggcccgaggacgaagggcgtgggaggtggggtgctaagtttanactaagttgagtaggtaaagtaaaattaaaaaagttttcgacacggtacgttaccggtaggaacggggacctaacgttcccaacctacgttacctaacgaacgtaacccgtaaccccctttaccaaaacccgtacgtaaccggtccttagttaaccttacctaacctaaaacgtacgaaaccgtagtttacgggtaagtaaccgtaaggttaacgaaaacggtacgaaccgtaactaacgtttaatttagtttacggtacggaacggtaaaaggttacgtttaccgggttttagggtacccggtaagtacttaagtaaccgttaagttacgggtaagggtaggtttaacggggtcggtaccggtaccgaccggtaccgggtacggggaaccggaacgggtacgtaccgggtacgtaccgtaccgttcctacgaccgtaccgtccccaccggtaacccgtaccgggcctaccggttccttacccccggttccccgacggtcccctaccccgtcccgttaaccggaacgtcccggaccgttacccgg

SEQ ID NO: 44258 - DNA, 892 bp, Homo sapiens
  misc_feature: GYAE6OF02F0LRF.31.14.B03.1.454.CMB.1.raw
tcagcagtagacgtcacgaccggtgctcgatttagtgtgagtagtttgggctgagctggttttcctcgttgctcttttaagaggtgtccagtgtcaggtgcaccgtggtggaatcgtggggaggcgtggtccggccgtcgggggtcctgagactctccgtgtgccatgtctgtcgtctagtaattcattcccgtcgacggcactagtggcagtgacgtacggtcgggtccgaccgaccggccccgaggacgaagggtcgtagggtaggttgggtacgtacgttaacgttttaataaacgtaagtttagtaaggtaaggtaaaagttaaaaaattttaaaaaacgtttccgtaaacgtaacggtaccgttaccgggtaagggtaaaccgggtccctaacttacccgaacctacgtacccgtaccgaaccggtaacccgtaccccttaaccgaaactaacgttacggtcttaaccgttaactaaccgtaaacgtaaaacgttacgaaacgtagttacggtacgtaaacgttaacggtaaacggaacggaaaccgtaacgttaactttaaagtttaacgtttagtaacggtacgtaaacggttaaactttcggttttacggtttacggtaaccgtaccgtaaatacgttacggtaaaggttgggttaacggttaagggtttcggtacgttaccgtaaccgggcggttaccgggacgggaaccgtaaacggggaccttacgggttccgtacccggttaccttccttaccggaccttacccgtaccccgtaccgaaccggtacccggttacctaccggtttcccccgttccccgttacccgcccgtaaccccgtaccccgttaccggtaacgaccggttaccctcccgggttaccgg

SEQ ID NO: 44259 - DNA, 808 bp, Homo sapiens
  misc_feature: GYAE6OF01DIJ2G.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggtccagtctgtgatgtctcagccaccctcagcgtctcgggacccccggcgagggggtcaccatctctgttctggaggagtccaatatcggatcttatcctgtcaactggtatcgggactccgaggccaccggcccccgactccgttatctatcgcttactaactcacgccggtccctcgacggggtccctcggcccgtatttccgtctcgggccttaccgaaacgtttccgtcgggacctaaccgttaccgacgggtacccttaacccgtcgggacccctaacgtttcccgtttacggtaactttcccgttacccgtaacggttcccgttagggtaacgggtacgttacgggtaacgggtccgtttaggtaaccttttaaccgttaaccgttcggtacggtaccgtaacggtccgttaacgggtacggggtaacttacgggtaacccgtaacggggtaccccggggtaaaccgggttccggttacggggggtttaccgggttacccgggggtaacccggggtaacgggggtaaacccgttaacggggtttaccggtaaccccgggtttacccggttaacggggttacccgtaaccgggtaacccccggtaaagggtcccccgttacccgggtcccccccgtttaccgggg

SEQ ID NO: 44260 - DNA, 531 bp, Homo sapiens
  misc_feature: GYAE6OF01BHY6D.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcaccggccccccgactccttatctatgctactaatcagccggccctcacggggtcccctgcccgattctctggctccaagtctggcactacaggctacctggccatccttgatctccagtctgaggatgagctgattactactgtgcagcagtgggatgacaggccggaggcgtgggtgttcgggcggagggacctaaggttcggaccgtccgtaggtccagcccgaaggcctcggccccctcgg

SEQ ID NO: 44261 - DNA, 532 bp, Homo sapiens
  misc_feature: GYAE6OF01DMYX7.44.55.E11.1.454.CMB.1.raw
tcagacagtatatacacgaccggtgctcgatttagcactcgcacgttgggtttggggagcttcagctgtgggtagagaagacaggactcaggacaatctccagcatggccggcttccctctcctcctcaccctcctcactcactgtgcagggtcctgggcccagtctgtgatgtctcagccaccctcagcgtctgggacccccgggcagggggtcaccatctcttgtctggaaggagtccaatatcggatcttatcctgtcaactggtatcggggactccaggcacggcccccgactccttatctatgctactaatcagcggccctcacggggtccctgcccgattctctggctccaagtctggcactacaggctacctggcctatccttgatctccagtctgagatgagctgtattactactgtgcagcatgggatgacagccggaacggcgtgggtggttcgggcggagggaccgtaaggtgaccggtcctacgggtcacggcccaagggcctccgcccccgtcggtccc

SEQ ID NO: 44262 - DNA, 558 bp, Homo sapiens
  misc_feature: GYAE6OF01BHPVY.44.55.E11.1.454.CMB.1.raw
  modified_base (478)..(478): a, c, t, g, unknown or other
  misc_feature (478)..(478): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgaggggaaggggctggagtgggtctcagtcatttatactggtgatttcacatactacgcagactccgtgaagggccgattcaccatctccgagggacaacttccgaggaactacggtttatcttacaaatgaacaacctgagaggcgacgacgacggccgtctattacngtgcgagacgaaggtcggcgtcgtcgggtagttggttaattacgtttcggtttagacgtttcgtggggtccctaacgggg

SEQ ID NO: 44263 - DNA, 656 bp, Homo sapiens
  misc_feature: GYAE6OF01AK46C.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccgaggcaccggccccccgactccttatctatgctactaatcagccgccctgacggggtcccctgcccgtattcctctggcctccaagtcctggcactacgaggcctacctggcctatcccttgacttcctccagtcgtgaggatggaggtcctaggtactttacgtacgtgttcgactaggtcctaagtcgggtaatacggaaccgacgggtacccgggaaacgggtccggttagggggttcggttaccggggacggggtaaacggggtacccgtaaaggggtttccggtaaccccggttacccgttaagggtaccccgtaacgggtacccccgaaacgggtcccgttacccggcccccccggtttacccgggg

SEQ ID NO: 44264 - DNA, 528 bp, Homo sapiens
  misc_feature: GYAE6OF01C0TMB.44.55.E11.1.454.CMB.1.raw
  modified_base (372)..(372): a, c, t, g, unknown or other
  misc_feature (372)..(372): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcacggcccccgatccttatctatgctactaatcagcgccctcgacggggtccctgcccgattctctgctccaagtctggcactacnggctacctggccatcttgatctccagtctgagatgaggctgattactactgtgcagcagtgggatgacagccggaggcgtgggtcgttcgggcggacgggaacctaaggtcgacccgtccgtagggtcacgacccgaaggcctcgcccccgtacgg

SEQ ID NO: 44265 - DNA, 609 bp, Homo sapiens
  misc_feature: GYAE6OF01D4U25.44.55.E11.1.454.CMB.1.raw
  modified_base (352)..(352): a, c, t, g, unknown or other
  misc_feature (352)..(352): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctgggaggaggcttagtccagccgtggggggtcccagagactctcctgtgcagcctctgggcctcaccgtcagcagcaactacatgaggttcggtccgccaggctccgaggggaggggctgggagtgggtctcgagtcattttanacgtggtgtatttcaactatactacgcagacctccggtaggaacgggcctacttccaccctactccgtacccgagggacctaattcccgaaggtaacctacggtttatcttacaaatcgaacaaccgtgacgaggccgaacgacaccgggtccctacttaacttcgtgcgacgagaacgaggtccgggcgtcgttcgggtagttcgtttaatttacgtttcggtttaggtacctttcggtgggggccctaacggggg

SEQ ID NO: 44266 - DNA, 726 bp, Homo sapiens
  misc_feature: GYAE6OF01D5C4C.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccgatctcttgttctggaaggagtccaatatcggatcttatcctgtcaactggtatcggggactcccgaggccaccggccccccgactccttatctatcgctactaatcacgccgccctcgacgggtccctgcccgtattcctcgtcggccctaccgaacgttcgtcgggacctaaccgtaccgacggtcccttaacccgttcggaccctaacttcccgtttagaaccttccgttcccgtaagtttccgtaggaaggtagttacggaacggtcttaggttaaacttttaaccgttacgttcggttacggaccgacgtaccgtaaggttcggggaattacggaaccgtacgggacccgggaacgggtcggttcgggggttacggttccgggggaccggggtaacggggtaaccgttaacggggtttaccggtaccccggttccgggtacgggtacccgtaacggtacccccggaagggttccccgtacccggtccccccggttaccgggg

SEQ ID NO: 44267 - DNA, 566 bp, Homo sapiens
  misc_feature: GYAE6OF01EB1QQ.44.55.E11.1.454.CMB.1.raw
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatgggagttttggctgagctgggttctccttgttggacttttaaaaggtgtccagtgtgaggtgcggctgatggagtctggaggaggcttagtccagccgtggggggtcccagagactctcctgtgcagcctcgtgggcctcaccgtcagcagcaactacagtgaggtttcgggccgccgaggctccggaggggaagggctgggagtgggtctcgagttctattttanacgtggtntatttcactatactacgcagactcggngaacggccatccacntctcgaggactatcagactacgttatctanaatcaacactgagacggcgacgacgacggtcctntagttcngtcgacgagaccgaaggtccggcgtcgtacggtagttcggttatttacgtttcgtttagaccgtttcggtggggccctaaccgggg

SEQ ID NO: 44268 - DNA, 660 bp, Homo sapiens
  misc_feature: GYAE6OF01AVP29.44.55.E11.1.454.CMB.1.raw
  modified_base (576)..(576): a, c, t, g, unknown or other
  misc_feature (576)..(576): n is a, c, g, or t
tcagacagtatatacacgaccggtgctcgatttagcactcgcacgttgggtttggggggggaggaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtcagccgtgggggtcccagagactctcctgtgcagcctcgtgggcctcgaccgtcagcacgcaactacatgaggttcgggtccgccaggcctccgaggggaggggtcgtgggagtgggtctcgagtcgtatttatacgtggtgtatttcacataccgtacgtcagtaccgtccgtaggaacgggccgtagttccaacgtacttccgaccgagggaacctaacttaccgaaggtaacctacggttttactacgtttaacaaagtacgaaacctaaccgtgacgaggtcccaacgaccgaccggtccgttactaagttcgtcgtacggacgtaacgaccgtaaaggtcccgggngtaccggttcgggaaacgttggtttaatttacggtttacgttttacggaacgttttccgggtacgggggcccgtaaacccgggg

SEQ ID NO: 44269 - DNA, 736 bp, Homo sapiens
  misc_feature: GYAE6OF01DIOAQ.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatgggagttttgggctgagcgtgggttctccttgttggacttttaaaaggtgtcagtgtgaggtgcggctgatggagtctgggaggaggcttagtccagccgtgggggtcccagagactctcctgtgcagcctcgtgggctcgaccgtcagcagacaactacagtggtacggttcggggtccgcgaggcctaccggaagggggaacggggcgttgggacggtgggtctacgagtcctaagttttactacgtggtagtactttacaacgtataactacggactaacgtaccgttaccggtaggaaacgggtcctaagttccaacccgttaacgtcccgttaacccggaaaggggtaaaccctaaacgtttaccccgaaagggttaaaacccgtttaccgggtttttaactaaccgttttaaccgaaaaactacggaaaaccctaacgtagggaacggtacgggaccgtaacggaacccgtaccgggtccgttacttaacgttacgtggtacgacgaacgaaccgtaaggtccggacgtacgttagggtacgttaggtttaacttacgtttcggtttacgaccgtttcgggcgggacccgtaaacggg

SEQ ID NO: 44270 - DNA, 543 bp, Homo sapiens
  misc_feature: GYAE6OF01DE5ZO.44.55.E11.1.454.CMB.1.raw
  modified_base (345)..(345): a, c, t, g, unknown or other
  misc_feature (345)..(345): n is a, c, g, or t
  modified_base (420)..(420): a, c, t, g, unknown or other
  misc_feature (420)..(420): n is a, c, g, or t
  modified_base (460)..(460): a, c, t, g, unknown or other
  misc_feature (460)..(460): n is a, c, g, or t
  modified_base (528)..(528): a, c, t, g, unknown or other
  misc_feature (528)..(528): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctcgaggggaagggctggagtgggtctcgagtcatttanactggtgatttcactatactacgcagctcgtgaaggcatcacatctacgaggacaattccaagtaacaggtttancttacaaatgaacaacgtgagaggacgacgacacggcctntaattctgtgacgaagacgaaggtcggctgtacggagttggttaattacgttcgtttagacgtttcgngggtccctaacgggg

SEQ ID NO: 44271 - DNA, 742 bp, Homo sapiens
  misc_feature: GYAE6OF01DEJCT.44.55.E11.1.454.CMB.1.raw
  modified_base (246)..(246): a, c, t, g, unknown or other
  misc_feature (246)..(246): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcgagggggtcaccatctcttgttctggaaggagtccaatntcggatcttatcctgtcaatggtatcgggactcccgaggcaccggccccccgatccttatctactgctactaatcagccgtcctcgacgggtccctcgcccgtattcctcgtggcctccgaacgtcgtcggcctaccgtacgtacggccttacccgtcgggaccctaacttccctttggaacctttcccgtaccccgaaggtttccctagggaacggtaacttcgggaacggtcttaacggtaacctttacccgttacgttaggttccgtaccgtacggcctaacgggttggggtaacctggaaccgtaccggggtacccggggtaaccgggttccggttagggggttccgggttcccgggggaccggggtaacggggtaaccccgtaaagggttttcccgggaaccccggtttacccggttaaacgggtacccgtaaaccgggtacccccgtaaaggggttcccccgttcccgggtcccccccggtttaccgggg

SEQ ID NO: 44272 - DNA, 720 bp, Homo sapiens
  misc_feature: GYAE6OF01DA6D0.44.55.E11.1.454.CMB.1.raw
tcagacagtatatacacgaccggtgctcgatttagcactcgcacgttgggtttgggggggagaggagcccagcactgggattccgaggtgttccattcggtgatcagcactgaacacagaggactcaccatggtagttttggctgagctgggttctcttgttggtactttaaaggtgtcagtgtgaggtgcggctgatggagtcgtgggaggaggtcttagtccgaggtccgtcggggggtacccagacgacctctcctgtgcgagtccgtcgtcgggtcctaccgaccggtcacggcaacgaccaaacctacgtagttaggtacggtttcggggtccccgccgacgggtcctaccggaagggggaacggggtcgtgggaggttcgggtctacgaggttactaagttttatacgttggtagtactttacgactaacgtaacctaccgcgtaacgtacctccgggtaaggaacgggtacctacgttaccaaccctatcccgtaaccgaagggtaactaacgttacccgaaaggtaaaccttacggtttactaccttaaacgaaaacgtacgaaactaccgtaggaaggacggaccgtacgacgtacggtctactattcgagtagcgagacgtaacggccgggtactacggttcgggtaagtttaggttttactttacgtttcgtttacgaccggtttcgggacggggtccctaaaccgggg

SEQ ID NO: 44273 - DNA, 691 bp, Homo sapiens
  misc_feature: GYAE6OF01CGO63.44.55.E11.1.454.CMB.1.raw
  modified_base (382)..(382): a, c, t, g, unknown or other
  misc_feature (382)..(382): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggtagtttggctgagctgggttctccttgttggtactttaaaggtgtccagtgtgaggtgcggctgagtggagtcgtgggaggaggcttagtccaggccgtgggggtcccaggagacctctccgtgtcgcagtcctcgtcgggcttccgaccgtcacgcagacaactacatggaggttcgggtcccgccaggtcctaccggaaggggacgggcgtggaggtcgggtctcgtagtctaatttatacgtggtntactttcgactactactacgacaagtactcggaagaaacggccgtaattaccacctactcacccgaaggtaacctaacttaccggaaacggtaaccttaacggttttaactacccgtttaaactaaaacgtcgtaaacccaacgttacggaacgggtaacggacccgtaacggaaccgtacccgggtaccttacgttaactttacccgaggttacgaacgggtaacgacgtaggtcccgggcgttacgtcgggtagtttacggttaatttcgttcggtttagaccggtttcgcggggaccctaacgggg

SEQ ID NO: 44274 - DNA, 603 bp, Homo sapiens
  misc_feature: GYAE6OF01C0LI1.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcagggggtcaccatctcttgttctggaaggagtccaatagtcggatcttatcctgtcaactggtatcggggactcccgaggccaccggccccccgacttccttatctatgactactaatcacgccgccctcgacgggtccctcgcccgtattcctcgtcggctccaagtctcggactacgtacgacggtcctaccgtcggcctacttccttgactcctaccagtcgtgaggtatggagtctagtacttactacgtgtcgccagctagtggatagacgacggccgggacggtcggtgggtcgtccggggcgggtaacgggtaaccgtaggttaccggtacccggttcggtaacggtccgaacggaccccgtaaggcccctccggtcccccgtacgg

SEQ ID NO: 44275 - DNA, 836 bp, Homo sapiens
  misc_feature: GYAE6OF01DNGZK.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttcttccttgttggtaacttttaaaaggtgtccagtgtgaggtgcggctgagtggagtcgtgggaggaggtcttacgtccgaggtcccggtcggggggtccccaaggacgtacctcgtccgtggtcgccgacgtccgtcgtcgggcctccgaccgtcacgcaacgaccaactacagtggtacggttcgggtcccgccgaggccgtaccgggaagggggaacggggtcgtagggtacggttcgggtcctacgtacgttacgttaagttttaacgtacgttggttagttaactttacgaactaacgttaaccgtaacgacgtaacggtacccgttacccgggtaaggaaaccgggtcccttaacgtttacccaaacccgttacgttacccggtaacccggtaacggggtaaacccttaaacggtttacccgaaaacgggttaaaccgtttacgggtttttaactaccgttttaaacgaaaagttaccgaaaaccctaacccggttaaggaacgggtaaccggtacccggaaacccgtaaccggtacccgggtacccttacgtttaacgttacgtgtaaccggacgtaacggaccgtaaagggtcccggacgtccggttagggtaacgttttgtttaactttacgtttccggtttagcccgttttcgggacgggacccgtaaccggg

SEQ ID NO: 44276 - DNA, 800 bp, Homo sapiens
  misc_feature: GYAE6OF01EYAN4.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccaggccgtggggggtcccagacgactctcctgtgcagcctcgtggctcaccgtcagcacgcaactacatggtaggttcgggtccgccgacggcctaccgagggggaacggggcctagggaggttcgggtcctcagttctaattttacgtacgttggtatactttccgaactacttaaccgtacgcgtaacgacccgtccggtaggaaccggggtaccctaagtttaccaaccctacttacccgtaccggaacggggtaaccctaaacgtttacccggaaaggggttaaacccttaacgggtttttaactacccgtttaaccaaaagttacccggaaaacctaaaccggtcggaacgggtaaccggacccgtaacccggaaccggaacccgggttaccccgttacttaaacgtttacccgtagggttaccggaacccggtaaaggttaaacccgtaaggggttccccggggaccgttaccgggttaacccggggtaaggttttacgggtttaattttaaccggtttcgggttttaacgaaccggtttttccgggtacggggaccccggtaaaccggggg

SEQ ID NO: 44277 - DNA, 941 bp, Homo sapiens
  misc_feature: GYAE6OF01C6W76.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtaacttttaaaaggtgtccagtgtgaggtgcggctgatggagtcgtggaggagcttagtccagccggtgggggtcccagacgactctcctgtgcagcctcgtcgggctcaccgtcacgcaacgacaaactacagtggtaggttcggggtcccgaccgaggccgtaccggaagggggaacggggcgttaggggtacggttcgggtcctacgtaacggttaccttaagttttaacgttaccgtttgggttacgttaactttttaccaaccgttaacgtttaaccgttaaccggaccgtaaacggtacccgtttaccgggtaaggggtaaaccggggtacccgtaactttacccgaacccgttaacgttccccgttaaccgggaacgggtaaaaccctaaacggtttacccggaaaacgggttaaaacccgtttaaccgggtttttaactacccgttttaaacgtaaaaaacgttaccggtaaaaaccccgttaaacccggttagggtaaaccgggaaccggggtaaccccggtaaaacccgggttaaaccccgggaaccccggggtttaccccgtttaaacgttttaaaccggttttaaccggttcgggttaaccgggaaccgggtaaacggtaaacccgggttaaacgggtcccggggacccggttacgggttaccggggttaagggttttacggtttttaaactttcgggttttaccgggttttacgtacccgggttttacggggtcccggggggtaacccgttaaacccgggggg

SEQ ID NO: 44278 - DNA, 670 bp, Homo sapiens
  misc_feature: GYAE6OF01AMZ7R.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgaggggaggggctgggagtgggtctcagtcatttatactggtgatttcactatactacgcagactccggtaggaacgggccgtattccaccatcctaccgaagggaccaagttcccaagggtaacctacggtttaatccttacaaagtcgaacctaaccgtggaacgacgggaccggaaccggaccgaaccggggtccccgttacgtaacgtttacccgtagggtacgaccggagtaaaccggtaaacggttccggggacccgtacggttacggggtaggtttacggggttttaaacttttacgttttaccgggttttacggtaccgttttccgggtcgggggtccccgtaaaccgggggg

SEQ ID NO: 44279 - DNA, 948 bp, Homo sapiens
  misc_feature: GYAE6OF01D4NYG.44.55.E11.1.454.CMB.1.raw
  modified_base (199)..(199): a, c, t, g, unknown or other
  misc_feature (199)..(199): n is a, c, g, or t
tcagacagtatatacacgaccggtgctcgatttagcactcgcacgttggggtttgggggggagaggagcccagcactgggattccgaggtgtttccattcggtgatcagcactgaacacagaggactcaccatggtagttttggctgagcgtgggttctccttgttggtaacttttaaaggtgtcagtgtgaggtgcgntgagtggtagtcgtgggaggtaggtcttacgtccgacggtccgggttcggggggtacccaggtacgtaccgttccgtccgtggtcgccgtacgtcccgttcgtcggggtaccctaccgacccggttccacggacccgaagacctaaaccctagtacgttacgggtaacgggtttcgggtaccccgaccgtacgggacccgttaccgggaaggggggtaacgggtccggtagggacgggttcgggttacctacgtacggtttaccttaagtttttacgtacggtttacggtgtttaacctttacgaaccgttaacgttaaccggtaccgacgtaacggtacccgtttaccgggtaacggggaacggttcccgttaaccgtttacccgaacccgttaccttacccggtaaccgggtaacgggtaaaccctttaaacccggtaaccggtaaaccggttaaaacccggttttaccggtttaactttaccgttaaacgtaaaccgtttaaccgaaaacccttaaccggttcgggaaacggtaccgggtaacccgtaaaccgggtccggtaaaccccggtccggttttaaccttacgttaaccggtgtacccgggaagtaacccggtacggtaaccgggttcggtaccggttacgggttaacggttaacggtttaccggtttttaagtacccggtttttacggttaccggttaaacggtttcccggggtcggggaacccccgggttaaaccgggg

SEQ ID NO: 44280 - DNA, 941 bp, Homo sapiens
  misc_feature: GYAE6OF01BVH80.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtggggggtcccagagactcctcctgtgcagcctcgtggctccaccgtcagcagacaactacagtggtaggttcgggtccccgccgacggtccgtacccggagggggaacggggcgtaggggtacggttcggggttcctacgtacggttaccttaagtttttaacgtaccgttgggttacgttaacttttaccgaacctaacttaaccgtaaccgaccgtaacggtaaccgttcccgggtaaggaaaccggggtcccgtaacgtttacccaaccctacgttacccgtacccggaaaggggtaaacccttaaacgtttaccccggaaagggttaaacccgtttaaccgggtttttaacttacccgtttaaaaccgaaaaacgtttaccggaaaaccccttaaacccgggttaggaaaccgggtaacccgggggaacccgtaaacccgggtaaccccggtaacccgggggttccccgtttaaccttttaaccggtttacccgttaaggggttaccgggtaacccgggaaaggttaaacccgggtaaaccgggggtttccccgggacccgggtttaacccgggttaccgggggttaagggtttttacccgggttttttaaagtttttacccgggttttttccgggtttttaccggtaacccggtttttcccgggggttaacccggggggaaaccccccggttaaacccggggggg

SEQ ID NO: 44281 - DNA, 781 bp, Homo sapiens
  misc_feature: GYAE6OF01B8ZE1.44.55.E11.1.454.CMB.1.raw
tcagacagtatatacacgaccggtgctcgatttagcactcgcacggttggggtttgggggggagaggagcccagcactgggattccgaggtgtttccattcggtgatcagcactgaacacagaggactcaccatggtagttttggctgagctgggttctccttgttggtaacttttaaaaggtgtccagtgtgaggtgcggctgagtggagtcgtgggaggaggtcttagtccgaggccggtgggggtccagacgtactcctccgtgtcgcgtacgtcctcgtcgggtcctacgtaccggtcaaggccaacgacaacgtacagtggtaggttcgggtcccgaccgacggccgtccgggaagggggaacggggtcgtagggacgggttcgggtacctacgtacgtacgttaagttttagtaacgttcggtagtactttacaacgtaactacgtaaccgcaacggtacctcggtagaacggccgtactaccgaacctcgtaccgtaccgaaggtaacctaacgttaacccgaaggtaaccgttaacggtttactacgtttaacaaacgttaccgaaaccgtaaccgtaggtaacggaccggacgaaccggaaccggtaccggtccgttaacgtttacgtaacggttcggtacggacgtaaacggtacctaacggggtcccgtcggtaccggttcggggttaacgtttaggtttaaccgttttacggtttaccgggtttacgtaccggtttccgggtaccgggggtacccgtaaaccccggggg

SEQ ID NO: 44282 - DNA, 683 bp, Homo sapiens
  misc_feature: GYAE6OF01E230G.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgggagtcgtggaggaggcttagtccaggccgtcggggggtcccagacgactcctcctgtgcacgcctcgtgggctcaccgtcagcagcaactacatgagttcgggtccgccgaggctccgaggggaaggggctgggagttgggtctcgagtcatttatacgtggtgtatttcactactactacgcagtacctccggtaggaacgggtccattaccaccacttccgtaccgagggtaacctaacgttacccgaaggtaaccgtaccggttttataccttaacaaacgtacgaaaccgtaacctaggaacggtacggaccgaaccggaccgtaccgggtcccgttacttaacgttacgtaggttcggacggtaacgaccgtaaacgggtccgggaccgtacggttcgggtagtttcgggtttaactttacgttttccggtttacggtaccgttttccgggtcgggggacccgtaaaccggggg

SEQ ID NO: 44283 - DNA, 611 bp, Homo sapiens
  misc_feature: GYAE6OF01BQOA3.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggaccccccgggcgagggggtcaccatctcttgttctggaaggagtccaatatcggatcttatcctgtcaactggtatcggggactcccgaggccaccggccccccgactccttatctatcgctactaatcagccgcctcgacgggtccctgccctattctcgtcggcctcagtcgtcggccacctcgacgcctcccgtcggccacgtcgaggtcgggtccgttcccgggtccggaggacgtcggacggtccttagtaattttcgtttcgtggtcgtcggttcgttagggatacgacgtacgttccgtggtaggtcgtactgtctaggttcgggacgggtacgacgacggtgtaccggtaccgttaccgacgtaccgaccggacccgacggtcccgtcccgtccccgtaccgg

SEQ ID NO: 44284 - DNA, 803 bp, Homo sapiens
  misc_feature: GYAE6OF01CI0CG.44.55.E11.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
tcagacagtatatacacgaccggtgctcgatttagcactcgcacgttgggtttggggagcttcagctgtgggtagagaagacaggactcaggacgatctccagcatggccagcttccctctcctctcaccctctcactcactgtgcaggtcctgggcccagtctgtgatgtctcagcccaccctnacgcgtcgtcgggacccccgggngaggggtcacggtattcgttttggtctggtaaacggtacggtacccaaagtacgtaccggaagttaattacggttatacgtggtactcggtactaattccgaagacgggacgtccggtccccacgtacccccgtcacgtaccgttaggtagggaacgtaactcgaacggtccggtcccgtacggtaccgggtccctacggaccgttacgttcgtacgtcggtacctacccgaaacgttccgtacggacctaccgtccgacgtcccgttaccgtcgaccgacttaccgtacgtccgggaccttaccggtacggtacctagggtaaacgaggtacggacggggttataacgttttaacttacgtcggtaaccgtcgttaccgtagttcggaactacggtaccgaacgtttcccgtaacggttgggttacggggtttacgggttacgggttaccgggggaccgggtaaacccggggacttaaccgggcccgttaccggggtacccggtttacccgggttaccgggtaccctaaaccgggtcccggtaaaccgggttcccgttaacccccgggttcccccgggttaccgttaaccccgg

SEQ ID NO: 44285 - DNA, 814 bp, Homo sapiens
  misc_feature: GYAE6OF01EQQ2U.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctccaccctcctcactcactgtgcaggtcctgggcccagtctgtgatgtctcacgccaccctcacgcgtcgtccggggaccccgggcgagggggtccaccatctcgtttgttcgtaggaaggaacgtaccaatagtcggtattcttactccgtgtacgtaacgtggttacgtccgggtacctcccgaggcccaccccggccccccgtacttccttacgtcttacgtcgtacttaactaactccgacggtcccggaccctcggtaccggttcccctcggtcccgtacttcctcgtcggcctactacgtccgtcggtacaccgtacgacggtcctaccgtcgtacctacgttccttacgtacctccgtactacgttcgtacggagtacgtacgggaacgttccttacgtaacgtttaccgtacgttacggtcgaacgtagtacgtaagggttacggaacgttaccggaaccgggtaacccggggtacccgggggtaacgggttccggggtacgggggtttaccgggtaccgggggtaaaccgggggtaaaccgggtaaacccggtttaacggggtttaccccggggtaacccggtttaacccgggttaaaccggtacccgggtaaccccgggaaacccccgggttaacgggtccccccggttaccccccggtcccccccggtttacccggg

SEQ ID NO: 44286 - DNA, 934 bp, Homo sapiens
  misc_feature: GYAE6OF01D9G99.44.55.E11.1.454.CMB.1.raw
  modified_base (209)..(209): a, c, t, g, unknown or other
  misc_feature (209)..(209): n is a, c, g, or t
tcagacagtatatacacgaccggtgctcgatttagcactcgcacgttgggtttgggggggagaggagcccagcactgggattccgaggtgtttccattcggtgatcagcactgaacacagagactcaccatggtagtttggctgagtcgtgggttctccgttgttggtaacttttaaaaggtgtccagtgtgaggtgcggctgagtggngtcgtgggagaggcttacgtccgaggtccggttgggggccctaggacgtacctccgtccgtgtcgcgacgtccgtcgtcgggctaccgacgtcacgcgacgacaactacgagtggtacggttcggccgacgtacggtccgtaccggaggggacgggtcgtgggtaggtcggtcgacgtacgtccgttaagtttacgtgttaggttacgctttaccgtaacgtacgttacccgtaccggacgtaacgtacccggttaccggttaagggaaccggtacccgtttaacgtaacccgtaccctaacgtttacccggaaccggtaaaggggtaaaccccttaacgttaacccgggaaaacggttaaccccgggttttaacgtttttaaccgtacccgtttaaaacgtaaaccgtaaaccggtaaacccgttaaacccggttaaagggggtaaccgtaaaccccggggccggttaaaaccccggaccccggggttaacccgggtttaccccggtttaaacttaacccggttttaaccgggttacggacccgggtttaaccggaaaccgggtaaacccgtacggggttaaccccggggtaccttacggggggttttacccggtaaagggttttccgggtttaaaaccggttttacccgtttttcgggttttaccgggaaccgggtttttacccgggggtaacccggggttaaccggggttaaacccccgggg

SEQ ID NO: 44287 - DNA, 797 bp, Homo sapiens
  misc_feature: GYAE6OF01D1MT4.44.55.E11.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (316)..(316): a, c, t, g, unknown or other
  misc_feature (316)..(316): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttcgggctgagcttgggttttccttgttgttattttacaaggtgtccagagtgaagtgcagttggtgggagtccggggganacgttgggtcccaggcctgggacgggtccctggacgactctcctgtcgtcgcctntggattcaccatccagtcgaccacttatatggactggggtcccnccgaggcctacggaggggaacggggctgggagtggcgttggccgacgaaagtaaaaacaagttcgaccagttcttatcaacagtacgtacgccgcgtctgtagaaacgtccaagtacttaccacccgttataccgaaagtcgtaacgtttacgtaacccttttaacgaaaagttaaccccttacgtttaagtttaaccgttactttaccggtacggtaaaccgttaaagtttaccgtaaaacccgttaaaacccgttaacgggaaaaaaccccgggtaacgggaaccggtaaccgggggtaaaccttaaacggtttacggtttaaatttttaaggttttcgggttaaggtttttacggtttttaagttttacgttaaagtaaccggtaaaacgggttaacgtttcccggaaccccgttaacggggttaccggggacccccgggttaaacgggtaaacccccggttcgggttaaacccccgg

SEQ ID NO: 44288 - DNA, 658 bp, Homo sapiens
  misc_feature: GYAE6OF01CQIDK.44.55.E11.1.454.CMB.1.raw
  modified_base (570)..(570): a, c, t, g, unknown or other
  misc_feature (570)..(570): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttgcttattttaaaaggtgtccagtgtgaggtgcaggtgagtggaagtttgggggacgccgtagttcgggccggggggcccctaagactctcctgtctcgtctctcgacccactttagcagctactggatgccacgtcggggtccgccgaaagcctacccgaagggaaacggggtcctggacttggttcgggtcctaccgtaacgttacttaaaccgaccgtagtacgggactactcacgttggttactacgaggaccgtccgtaggaacgggcctaattcgtatcgatcctacacgagactaagtcgtaacggaaactacggttataactttaaacaatagaactagtactaagacggtacggaaggacgacgtctagtacttatagttgtcgtagtagtacctttntgttattcggtacggtttggggtatttaggtcggtttaccggaccctacgtaccggcgggtaccctaggggtacccttcgggttaccg

SEQ ID NO: 44289 - DNA, 716 bp, Homo sapiens
  misc_feature: GYAE6OF01BDHTV.44.55.E11.1.454.CMB.1.raw
  modified_base (262)..(262): a, c, t, g, unknown or other
  misc_feature (262)..(262): n is a, c, g, or t
  modified_base (360)..(360): a, c, t, g, unknown or other
  misc_feature (360)..(360): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcgctgatggagtctggaggaggcttagtccagccgtggggggtcccagagactcctctgtgcagcctntgggctccaccgtcagcagacaactacgatgaggttgggtacccgcgaacggctccgaggggaagggctgggagtgggtctaccagtctagttttaanacgttggtgtaactttcaactatacctaacgccgagtactccgtaggaacggtaccggtattaccaacctactacctaccgaacggggaactaaacgtttaccgaacggtaaaccgttaaccggtttaacttacttaaccaaagtacggtaaacaaaccctggaaacggtacggaggaacccgaacggacccgggtaccgttaccgttaatttaacgtacggttcggaccgaaggtaaccgaaaagggttcccgggacgtaccggttaacccgggtaagtttacgggtttaactttaacgttttccgggtttttaacgacgtttttcccggacgggggttaccggtaaaccggggg

SEQ ID NO: 44290 - DNA, 789 bp, Homo sapiens
  misc_feature: GYAE6OF01DLMTX.44.55.E11.1.454.CMB.1.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (613)..(613): a, c, t, g, unknown or other
  misc_feature (613)..(613): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggtagttttggctgagctgggttctccttgttggtacttttaaaaggtgtccagtgtgaggtgcggctgagtggagtcgtggaggaggcttagtccgacgccggtcgggggtcccagagactctcctgtgcngcctgtggcctcgaccgtnacgcagacaactacagtcggtaggttcgggtcccgacctagggccgtaccggaacggggtaagggggtccgtaggggaggttcgggttctacggtactacgttattttaacgtacggtttggttcgttaacttttaccaaacgttaacttaacccgttaacggacccgtaacggtacccgtaccgggtaagggtaaaccgggtacccgttaactttacccgaaccctacgttacccgtaccggaaagggtaacccttaaacggtttcccgaaaagggttaaccgttaccggttttaactacgttaactaaaagtacgaacccgttaaacnggaaccgggtacggaacccaacgaacccggaccggttccgtaactttacgtacgttcggacggtaacgaagtaaccgtaacggttcgggacgtaccggttagggtaaggttttcgtttaacttttacgtttcggtttacgaccggttttcgggaccggggtccgtaaaacccgggg

SEQ ID NO: 44291 - DNA, 868 bp, Homo sapiens
  misc_feature: GYAE6OF01D9RP3.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcaggtcctggcccagtctgtgatgtctcagccaccctcagccgtcgtccggggaccccggcgacggggtccaccgagttctcgtttcgttcgtaggaaacggtaacgtaccaaagttacgtccggtattcttaactccttagtacctaacgttggtaacgtccggggtacctcccggacgccgaccccggccccccgtacttaccttactccgttatccgtaccttaacgtactccgacgtacccggtcccgtacggtaccggggttcccctcggacccgttactttccgtaccgtcgttacccgtaccgtaaggttccacgggtaccctaaccgtaacgtaccggttacctaacccggttcgggtacccttaactttcccgtttaggaaccctttcccgtaccgtaacgttcgtaacgggtaacgtcggttaacgggaccgtttacggtacgttaaactttaaaccggtttacgtacgggtagtaccgtagtaaccggttaagggttagggtaccgtaacggtaaaccggtccggggtaacccggggttacgggttaccggggtttcggggtacgggttaaccgggggccgggtaaaacgggggttaccgttaaccgggtttaccgggttaaccccggtaccgggttaacggtaacccgacccggggtaaccccgttaacggggtcccccgttacccccgggtcccccgtttaaccgggg

SEQ ID NO: 44292 - DNA, 702 bp, Homo sapiens
  misc_feature: GYAE6OF01ALOFI.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtgggaggaggcttagtccaggccgtggggggtcccagagactctcctgtgcacgcctcgtgggcctcaccgtcagcagcaactacatggagttcgggtccgccgaggcctccgaggggtaacggggctgggacggttgggtctcgaacgttctagttttactacgtggttagattttacacgtattactacgcagacctccggtagaacgggccgtacttacaccctatcctccgagggactaacgttccgaacggtaacgtacggtttactacgttaactaaacgtacgaacctaacgtacgacgggtacggaccgaacggaccgtacccgggtaccgttacttaacgtttacctacggttacgaccggtaagtacccggtaaagggtcccgggcggtacccgttacgggtacggtttaggtttaacgtttacggttttacggttttacggtacccggtttacgggttcggggtacccggttaaacccggggg

SEQ ID NO: 44293 - DNA, 825 bp, Homo sapiens
  misc_feature: GYAE6OF01B9R9J.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcacgcgtcgtcggggaccccccgggcgacgggggtccaccgacgtctcttgttcgtaggaaggtacgtaccaagtatcggattcttactccgtgtccgtaaacgtcggtaacgtccggggaccttcccgaggtcccgaccccggtccccccgacttccgtttactccttactcgtacctacttaaactcgacggccgccctcggacgggttccctcgtcccgtattccgtcgttcggaccgtccgaacggttccgtcggacctaactaccgacggtccttaacccgtccggtacctacgtttcccgtttcggaacctttcccgtacccgtaacggtttccgtagggtaacgggtacgttaggtacgggtacttacggttaacgtttaacctacggttaggttacgaccgtagtaccgtaagggttcggggtaattaccgggaaaccggtaaccggggtacccggggttaccggggtaccggggtttcggggggttaccggttccggggggaaaccgggtaaaccggggtaccgttaaacggggtttaccggggtaaccccgtttaccgggtaacgggtacccggaacccgggtaccggtaaaccggtcccgttcccccgggtcccccggttacccggg

SEQ ID NO: 44294 - DNA, 777 bp, Homo sapiens
  misc_feature: GYAE6OF01B1EWI.44.55.E11.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgattcgtctcagcccacctgagcgtcgtcgggaccccgggcgagggggtccactatctcttgttcgtggaaggaacgtcaatatcggattcttatcctgtcaactggtagtcgggacctccgagccgaccggcccccgactccttancctntcgtactactaatcacgccgcccgtcgtacggggtcctcgccgtacttcgtcgtacggtcctcgtaaacgttcgtacggcctaacgttaccgtaacggtcccgtttaaccggtcgggaccccttaacggtttcccttacggtaactttcccctacccggtaacgttcccggtttaagggaaccggtaagtttacgggaacgggttacccgtttaggttaaccgtttaacgttaacgtttcggttacgtaccgaacgggtacctaagggtacggggtaatccgggtaaaccgtaccggggaacccgggaacgggttccggttagggggttccgggttaaccggggacggggtaaccgggtaacccggtaaggttaccgggtaccccggttacgtttaccgggaaccggacccgtaacccgggtaagggtcccctacccggtacccccggtttcccggg

SEQ ID NO: 44295 - DNA, 752 bp, Homo sapiens
  misc_feature: GYAE6OF01EFLD9.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtggttctccttgttggtactttaaaggtgtccagtgtgaggtgcggctgagtggagtcgtgggaggaggcttagtccaggccggtcgggggtcccagacgtaccttccgtcctggtcgacctacgtccgtcgtcgggccttccgacccgtcgacgcgaacgacctaaactacagtggtacggtttcggggcccgccgtacggccgtaccggagggggaacggggtcgtagggaggttcgggtcacgtaggttcctaagtttacgtcgtggtacgtatttacaaccgttataccgtaccgacgacgtacccgtcggtaggaaccggtccgtacttcaccgtacttccgtaccgaggtaactaacgttccgaacggtaccgtacggtttatacttacaacgtacgaacctacgtaggaacgtacggaccgtaacggacccgtaccggtaccgttactaagtttacgcggtacggaccggtaaacgacccgtaagggtcccgggtacccgtcgggttacgggtaggtttaccggtttacttttaaccgggtttccggtttaggttaacccggtttccgggtcccggggtacccgtaaacccggggg

SEQ ID NO: 44296 - DNA, 775 bp, Homo sapiens
  misc_feature: GYAE6OF01DSANH.44.55.E11.1.454.CMB.1.raw
  modified_base (377)..(377): a, c, t, g, unknown or other
  misc_feature (377)..(377): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggtagttttggctgagcgtgggttcttccgttgttggtaacgttttaaaaggtgtcctagtgtgaggtgcggctgagtggagtcgtagggaggtggacttacgtccgacggtccgggtcggggggtacccaggacgtaccttcgttccgtgtcgccgtacggcccttcggtcgggtcctccgtaccgtacgacggactaacgacctaaacgtacgtagttacggtacgggtttccggggtccccnccggtacggtcccggtaccgggtaaggggggtacggggtacgttcggggtacggttcgggttactcgtaacgttacgttaacttttaggtacgttcggtagttactttacacgttaactaccgtacgtaacgaggtaccgtacggtaggtaaacggtccgttacgtaaccaccgtacttacccgtaacggaacggtaacgttaccgtacgtaacgtaacggttagttactacttaacgtaactacgtacaacgtgaagacgaccgaacgacgtccgtcgttactacttcgtagcggaacacggaacgtcggccgtacggtacggttaggtacgggtttacgtttagtttacggtttaccgttggtaccggtttccggaacgggtcccggtaacccggg

SEQ ID NO: 44297 - DNA, 798 bp, Homo sapiens
  misc_feature: GYAE6OF01DEKFU.44.55.E11.1.454.CMB.1.raw
  modified_base (181)..(181): a, c, t, g, unknown or other
  misc_feature (181)..(181): n is a, c, g, or t
tcagacagtatatacacgaccggtgctcgatttagcactcgcacgttggggtttgggggggagaggagcccagcactgggattccgaggtgtttccattcggtgatcagcactgaacacagaggactcaccatggtagttttggctgagctgggttctccttgttggtacttttaaaggtntcagtgtgaggtgcggctgagtggagtcgtggaggaggcttagtccgaggtcccggtggggggtcccagacgacctccttccgtgtgcgacgtcctcgtcgggtctccgaccgtcagcagaccaaactacgatggtacggttcgggtccgccgacggccgtccggaaggggaacggggtcggtagggtaggttcgggtctacgtacggttattaagtttaacgtcgtaggttagtaactttacaactaacttaaccgtacgactaacggtaccgtccggtagggaaaccgggtaccgtaacttaccgaaccctacgttaccccgtaaccggaacgggtaaccttaacggtacccgtaaacgggttaaaccgttaaccggttttaaccttaacgttaaaccgtaaaagttaccgaaaccccgtaaaccgttacgggaacgggtacgggaaccggtaaccggaaaccgtccgggttacccgttactttaacggttaccgtaggtccggaacggtaacggtaccgaacgggttccggacggtacggttacggttaacgggttagttttacgtttacgttcggtttaacgaccgtttcgggtaccggggccgtaaaccggg

SEQ ID NO: 44298 - DNA, 859 bp, Homo sapiens
  misc_feature: GYAE6OF01ER1S8.44.55.E11.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
tcagacagtatatacacgaccggtgctcgatttagcactcgcacggttgggtttggggggggagaggagcccagcactgggattccgaggtgtttccattcggtgatcagcactgaacacagaggactcaccatggagtttttggctgagcgtggttcgtcctaggtcggactttaaagtgtccagtgtgagtgcggntgatggntcgtggaggtgtcttagtccaggtccggtcgggggtcccagacgtctccgttcgtgtcgacgacgtccttcggtcgggtacctccgtaccgtacagccgacgtacctaaacctacgtaggtagggtacggtttcccggggacccgtaccggcggtaccggtaaccggggaaggggggtacggggtcggtaggggtacgggttcgggaccttacgttagttaccgtttacgtttacgttaccggttgggtttacttacgttttacaacgtacgttaaccgtaaccggtacgtaaccggtacccggttcgggtaacggggaacggtcccgtaatacccgacctaccgttaaccgtaccggtaaacggtaacctaaccgtaaccggtaacgtaaaccggtttacgttttaactaccgttaaacgaaacgttaaccgaaccgtaacggtagggtacggaacggtaacccgtaaccggtacgtacccggttacgttaaccgttaagttaccggtaggttaccggaccgtaacggtaaacggtaccgggtaccggtaccggttacgggttaacgggttaggtttaaccggttttaggtttaacggttttcggttaccggttaccggtttccgggtacccgggtaacccgggtaacccggg

SEQ ID NO: 44299 - DNA, 863 bp, Homo sapiens
  misc_feature: GYAE6OF01BOWT4.44.55.E11.1.454.CMB.1.raw
  modified_base (273)..(273): a, c, t, g, unknown or other
  misc_feature (273)..(273): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcacatggagttttggctgagctgggttctccttgttggtacttttaaaaggtgtccagtgtgaggtgcggctgagtggagtctgggaggaggcttagtccgagccgtcggggggtcccagacgacgtcctccgtgtgcacgcctcgnggtctccgaccgtcagcagacaactacgatggtacggttcgggtcccgccgacggcgtaccggagggggaacgggcgtgggaggtcgggtctgtacggtctagttttatacgtggtagtactttccaactactaacgtaccgacgaacggtaccgttaccggtagggaacgggtaccgtacttacccaaccgtaacttccccgtaccggaacgggtaaaccctaacgtttcccgaaacgggtaacctttaacgggtttttactacgtttaaacaaagttaccgaaaccgtacgttcgggaaagggaccgggtcccggaaaccgttaaccgggaccccgggttacccgtttactttaaacccgtttaccggtgggttaacccggaccgggtaaacgtaaacccggtaaccggggtttcccggggcccggtttacccgggttaaacgggggtttacggttttttaaccggggtttttaacgtttttttaaaccgggttttttccgggtttttaaaccgggtttaaccccgggttttttccgggggttaaacccggggggggtaaccccccgtttaaaaccccccgggggggg

SEQ ID NO: 44300 - DNA, 663 bp, Homo sapiens
  misc_feature: GYAE6OF01ENXLR.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtccagagactctcctgtgcagcctcgtggctcaccgtcagcagcaactacatgaggtttcggccgccgaggctccggaggggaagggctgggagtgggtctcgagtctatttatacgttggtgtattttccaactattaccgtaccgcaacgtacctccggtaggaacgggccgtattccacctatcccgtaccgaagggaactaacgttaccgaagggtaacctaaccgggttttatacctttaagaaatacgaaactaaccgtaggaacgacggacgaacccgtacgacccgggtaccgttacttaacgtttacgtaggtacggaccggaagaccgtaaggtccgggccgttcgtacgggtagtttacggtttaatttacggtttcgttttagacccgtttcgggtccggggcccgtaaacgggg

SEQ ID NO: 44301 - DNA, 675 bp, Homo sapiens
  misc_feature: GYAE6OF01DR5A4.44.55.E11.1.454.CMB.1.raw
  modified_base (176)..(176): a, c, t, g, unknown or other
  misc_feature (176)..(176): n is a, c, g, or t
  modified_base (398)..(398): a, c, t, g, unknown or other
  misc_feature (398)..(398): n is a, c, g, or t
  modified_base (561)..(561): a, c, t, g, unknown or other
  misc_feature (561)..(561): n is a, c, g, or t
  modified_base (583)..(583): a, c, t, g, unknown or other
  misc_feature (583)..(583): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgtggacttttaaaggntcagtgtgaggtgcggctgagtggagtcgtggaggaggcttagtccagccgtggggggtcccagacgtactctcctgtgcaggcctctgggcctcgaccgtcaacgcagcaaactactagtggtacggtttcggggtccgccgaaggcctaccggaaggggggaacggggtcgtggggtaaggtggggttcctaggtacgttccaattttacgtacgtggtntactttacacgtatacgtaacgcgtacgaccgttccgaggaacggtccgtattaccgacctacgttcccgtaccgaacgggtaactacgttaccgaaggtaaccgtacggttttactacgttacaaacgtacaaccgtaccgtagacggacggcgacggaacnccgggtacctcgttaattacgngtagacgacgacgtacggtcggtaccgtgtacgggagttacggttatttacgttcgttacggtacggtttcgtcgggggcctaaacccgggg

SEQ ID NO: 44302 - DNA, 644 bp, Homo sapiens
  misc_feature: GYAE6OF01EI9RR.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcacccctcctcactcactgtgcagggtcctgggcccagtctgtgatgtctcagccaccctcagcgtcgtcgggacccccgggcgagggggtcaccatctcttgttctggaaggagtccaatatcggatcttatcctgtcaacgtggtagtcgggactcccgaggccaccggccccccgtactccttactcttacgtcgactactaactcgacgccgtcccgtacggaccggggttccctcggtcccgtacttccgtcgttcgctaccgagtcgtcgactacgtacgacggtcctaccgtcgaccctacgttccttgacttcctaccgtacgttcgtggagtgtcggaggtcgtagtactttactacgtgtcgactagtctaggtaggtatagaaccgaggtacccgggaacggtcggttggggtcggtccgggacgggtaacgggtaccgtaaggttccgtcccggtaccgtacggaccgtaccggacccgaaggtcccgtccggtcccccgtcggg

SEQ ID NO: 44303 - DNA, 805 bp, Homo sapiens
  misc_feature: GYAE6OF01CUVCS.44.55.E11.1.454.CMB.1.raw
  modified_base (194)..(194): a, c, t, g, unknown or other
  misc_feature (194)..(194): n is a, c, g, or t
tcagacagtatatacacgaccggtgctcgatttagcactcgcacgttgggtttggggggggagaggagcccagcactgggattccgaggtgtttccattcggtgatcagcactgaacacaaaggactcaccatggtagttttggctgagtcgtgggttctcttgttggtaacttttaaaaggtgtcagtgtggnggtgcggctagagtggagtcgtggaggtgtcgttacgtccgacggccggtcggggggtccaggactctctccgtgtcgcgcgccgttcggtcgggccttaccgaccgtacacgccaacgaccaaactacgaagttgggtacggtttccgggcccgaccggtacggccggtaccgggaagggggtaacggggtcgttaggggtacgggttcgggttactacgtacgttacttaaattttacgtacggttggttcgttaactttaccgacttaacttaaccgacgtacgaacggttaccgtccgggtaacggaaccgggtcctacgtacctaccgacgtttcccggaacggaaaccggtaacttaaacggttacccggaaaggttaaccgtttaaacggtttactaccgttaaaataaagttaacccgaacttaacggaaggacgacgggaccaacggtaccgtaccggtacttacttagtccgtagacggtaccaaagtacggtaccggtcgaccggtggttaacgggtttatttacgggtttacttttcggtttaccggtttggttaaacccggtcggggtaaccgggtccccggaaacgggttacccggg

SEQ ID NO: 44304 - DNA, 730 bp, Homo sapiens
  misc_feature: GYAE6OF01DSW3O.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgacgggggtccaccgattccttcgttgttctagggaaggtaacgtaccaatacgtcggacttctttaactcctgtactaacgttggtagtccggggacctcccgacggtccgaccccggccccccgtacgttccttactcttactcgtaccttaactaactcgtacggccgtccccgtacggtaccggggtccctcggcccgtattccgtacgtcggccttacccgaagttccgtacggacctacgtacgacggtccttaccgtcgaccctacgttccgtttacgaccttccgtaccgtaagtcgttaggacgtagtcgaggtcctagtaactttactagttcgtcgactagtacgtaggtacgggtagtacggaacggtaccgggtaaccgggtacggtcggggtttcggggtacgggttccggggacgggggtaacgtaccggttaacgggtccggtacccggtacgttacggaccgtccggaacccggtagccccggttcccggtccccgttaccgg

SEQ ID NO: 44305 - DNA, 733 bp, Homo sapiens
  misc_feature: GYAE6OF01ESZ3R.44.55.E11.1.454.CMB.1.raw
  modified_base (177)..(177): a, c, t, g, unknown or other
  misc_feature (177)..(177): n is a, c, g, or t
  modified_base (670)..(670): a, c, t, g, unknown or other
  misc_feature (670)..(670): n is a, c, g, or t
tcagacagtatatacacgaccggtgctcgatttagcactcgcacgttggggtttgggggggagaggagcccagcactgggattccgaggtgtttccagttcggtgatcagcactgaacacagaggactcaccatggtagtttggctgagctggttctcttgttagtactttaaagtntcagtgtgaggtgcgctgatggagtcgtggaggtaggtcttagtccgagtccggtcgggggtaccagacgtacctccgtccgtgtcgcgtacgtccgtcgtgggtcctaccgtaccgtcgacgccagacctaacgtacagttaggtacggttcgggcccgccgacggtaccggtacggagggggtacgggtcgtagggtacgttcggtactcgtaacgttactagtttacgtacgttggttacgttacttacgtaactacgttaccgaccgactaacgttaccgtacggtaacggaacggtcctacttaccgacagtttacccgagaacggtactaacggttaccgaaggttaaccttcggtttaactcgtaaacgaaagtccgtaaacacggtacggagggaaccgtcccgaaccgtccgtaccggttacttattaactcggtagccgaagtaaccgacggtaggtcccgggaacgttcggttaacgggttntttgtttaaaccttcgggttttactacgtacccgggtttcggaaccggggtaccctaacgggg

SEQ ID NO: 44306 - DNA, 812 bp, Homo sapiens
  misc_feature: GYAE6OF01CZU6M.44.55.E11.1.454.CMB.1.raw
  modified_base (241)..(241): a, c, t, g, unknown or other
  misc_feature (241)..(241): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggactttggggctgagtagttgggttttcctcgttgcttacgttttaaaggagggttggaccctaggttgtcgagggtcgacaggtcgttaggtgggtaagtttcgggngggggggaacggacggcccgggacccaggtcccgttacggggtaacccttccccgtaggtaacgtaccttccgtccgtgtcgccacgtccgtttcgtggtactttcgatttccgttacgacggtaccttacgcgtacctagtcgaccgtaccggtcgggttcccgaccgtacggtccctaccggagggtaccggaagggggttccgtaggggtacgggtcggggtacggtaaccttaagtttaacttacggtacgtaaaggtaaacgaggttaggtaaacgtttaaggaaacgtaaccggtacgtaacgggacgtaacccgtacgggaacggtacgggaccgttacgtacccgaccggttctaccgaagtaacgtaactaaaccgttaccgaacgtaaccgactactcggactaacgttctagaactaaagtcctaaacgtacctacgaacgttagtacggaccggactaccggtacgtacgtttacgttagttacggttcgtacggtaccggaccgtacccgtccccgtacgtaacgggtccccggttaccgtccgtacggttaccccgg

SEQ ID NO: 44307 - DNA, 751 bp, Homo sapiens
  misc_feature: GYAE6OF01DDJ32.44.55.E11.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (410)..(410): a, c, t, g, unknown or other
  misc_feature (410)..(410): n is a, c, g, or t
tcagacagtatatacacgaccggtgctcgatttagcactcgcacgttgggtttgggggggagaggagcccagcactgggattccgaggtgtttccattcggtgatcagcactgaacacagagactcaccatggtagtttggctgagtctgggttctccgttgttggtaacttttaaaggcgtcagtgtgaggtgcggntgagtggagtcgtgggaggaggtctttagccagccgtgggacgtcctgacgtctcctctgtcncagtcctcgtggtacttctacttttcgagttattatgtctatgccaggtcgggtccncgacggctaccggnggaccggaagggcgtaggggtggtcggggtagacgagtctacgttcggtggtcgtagaggtaacggtaaaaggtaaanataacgtagtaacggaacgttccggtaagggaacggtccgttacgttccctaccgtcgtaccgagtaaccgtaaacttaaccgtaaccgaactaacccgtaacgttagttactaacgttaataaacgttaataaacgttaacgtttaacggaaggaaccggtacccgggtaggtacccgttaccggtacctttacgtttaacttacgtttaacgttacccggaaccgttaaccgttcctaaaccgttttacccgtttaccggtacccggggttacggggacccgttaaacggggtccccgttaaccggttccggtaaccccggtcccggtttaacccccgg

SEQ ID NO: 44308 - DNA, 750 bp, Homo sapiens
  misc_feature: GYAE6OF01CEDCF.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtgggaggaggcttagtccgagccgtgggggtcccagacgacctctcctgtcgcgacgcctcgtgggcctccaccgtcagcgacgacaactacagttacggaggttcgggtccgccgacggccgtaccggaagggggacggggtcgtagggtacggttgggtccgtacgtaggtacttaagtttactacgttggtatacgtttcaactatactagtgactacgtaccgttacggtacgggaaccgggccttactaccgacccaacttcccgtaactaaggaaccgtaaactaaccgttaccgaaaccggtaactccgttacgttactacttccgtacgtaacctaaacgtaggaaacccgtacggacccgtagggtaacggaacccggaaccgggtaacgggacccgtaccgggtaagtttggtaaaccgtttagtttaccggtgggttacggaacccggggttaaggtaacccttaaaggtttaccggtttaaacggttacttaaacccccttaccggtaacccgtttggtaaaccccgggg

SEQ ID NO: 44309 - DNA, 769 bp, Homo sapiens
  misc_feature: GYAE6OF01DANUI.44.55.E11.1.454.CMB.1.raw
  modified_base (207)..(207): a, c, t, g, unknown or other
  misc_feature (207)..(207): n is a, c, g, or t
  modified_base (280)..(280): a, c, t, g, unknown or other
  misc_feature (280)..(280): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggtagttttggctgagtcgttgggttcttccgtttgttggtaactttttaaaaggtgtccagtgtgaggtgcggntgagtggagtcgtggaggagtcttacgtccgaggccggtcggggggtacccagacgtaccttctccgtgtgcncgtccgtgtcgggcctccgaccgtcagcagacaactacagtggaggttcggtccgacgtaggccgtaccgggaaggggaacggggtcgtgggagggttcgggtcctacgtagttcctaagttttactacgtggttacgttactttacgaactattaactacgactacgtaccgtacggtacggaacggtacgtacttacaccttactccgtaccggtaacggaaccttaacgttaccgaaacggtaaaccgttacggtttaacttacgttaaaccaaagtaacgtaaccgtaaaccgtggaaacgggtacgggaacgaacccggtaaccgaccgggttacccttacgtttaaattcccgttggacggaaccgtaggaacgtaacgggtccggacggtacggttacgggttaaggtttaggttttaacttaggttttaccgggttttacgtacgggttttcggacccgggggtacgttaaaccccggggg

SEQ ID NO: 44310 - DNA, 843 bp, Homo sapiens
  misc_feature: GYAE6OF01CKLPR.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtgggaggaggtcttagtccgaggccgtgggggtcccaggagtacctccgttccgtggtcgacgacgtcccttcgtcggggtccttccgacccggttcaacggcgaacgtacctaaacctacgagttcggtacggttccggggtcccgccgacggtcctaccggaaggggaacgggtccgtagggtcggttgggtcctacgtagttacgtattttacgtacgtggttctaactttacactaactaaccgtacgtacgtacggtacgtccggtaagggaaccgggtacccgtacttaccgaacctaacgttcccgaaccggtaaggtaaccctaaacgttaccggaagttaaaccgttaacggttttactacccgtttaaacgaaaacgttaccgtaaaacccgtaccggtaggtaacgggtaacccgggaccgtaaaccggaaccggtaccgggttcccttaacgtttacgttacgtacgggtacgtaaccggtacggaaacccgttagggacccgggtccggtaaccggtttaaggggttaccggtttaggttttaacgttttaacggttttcggtttaccgtaacgggttttcccgggtaaacccgggggtaaccccggttaaaccccgggg

SEQ ID NO: 44311 - DNA, 847 bp, Homo sapiens
  misc_feature: GYAE6OF01CI99D.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcgaggtcctgggcccagtctgtgatgtctcacgcccacctcagtcgtcgtcgggacccccgggcgacggggtccaccgattccttcttagttcgtagggaacggtaacgtccaatacgtcggacttcgttactccgttacgtactaacgttcggttaacgtccggggtaccttaccccgacgggacccgaccccgggtcccccccgtaacttccccgtttaacgtccttaacgtcgtacttaacctaacgtccgaacgtcccggtcccttcggtaccgggtccctacggtcccggtactttcgtccgtacggtacccttaccgaacgttcgtacggtactaaccgtacgtacggtaccttaaccggtcggtacccttacgttaccgttacgtaccgttaccgtacccgtacgttacgttacgggtaacggtacgtcgggtacggtactttacggttaacctttaccggtttacgttacggtacgtacgtacggtacgtaacgggttacgggtaacgtacggtaaccgggtaaccggggtaaccggggttaccgggttccgggttacggggtttccggggtaccgggtaaccgggggaaccgggttaccggttaagggttaccggtacccggttaaccggtacgggtaccgtaacccggacccggtaaacggcccgttacccggtccccggttaccccggg

SEQ ID NO: 44312 - DNA, 628 bp, Homo sapiens
  misc_feature: GYAE6OF01ASMN9.44.55.E11.1.454.CMB.1.raw
  modified_base (478)..(478): a, c, t, g, unknown or other
  misc_feature (478)..(478): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggcctcgaccgtcagcagcaactacatgagttcgggtccgccgaggctaccgagggggaacggggcgtgggaggtgggtctcgacgttctatttatacgtggtgtatttcactacttactacgcacgtactccggtaggaacgggccgtacttccaccactcctaccgaagggaacctaacgttaccgaaggaaccttacggtttactctttanaaactcgaaccacgtgaagacggaccgaacgaccgaccggtcctatacttacgtgtcgcgagaccgaaggtccgggctacggtacgggtagtttaggtttaatttacggtttcgtttacgaccgtttcggtgggggccccgtaacggggg

SEQ ID NO: 44313 - DNA, 736 bp, Homo sapiens
  misc_feature: GYAE6OF01C5E8A.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggtaacttttaaaaggtgtccagtgtgaggtgcggctgatgggagtcgtgggaggaggcttagtccaggccgtggggggtcccagagactctcctgtgcacgtccgtcgtcgggcctccgtaccgtcagcagacaactacatggaggttcgggtccgccgaggccgtaccggaagggggaacggggtcgtaggggacggtttcgggtcctacgtacgttacgttaattttaagtacgttggttagtaacttttaccaactaacttaaccgtacgacctaacgtacccgttaccgggtaaggtaacggggtccgtaacttccgaaccgtactaccgtaccggtaacgggtaactaacgttaccgaacggtaaaccgttacggtttactacttaacaaagtacgaacctaacgtaggaagacggacgaacgaccgtaccggtaccgttacttacgttacgtggtacgacggtaacgacgtacgggtcggtacggtcggttacggttaggttacggttttagtttacgtttcggtttacgttacggtttccggtcgggggtccgtaaacccgggg

SEQ ID NO: 44314 - DNA, 729 bp, Homo sapiens
  misc_feature: GYAE6OF01B9EYE.44.55.E11.1.454.CMB.1.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagacagtatatacacgaccggtgctcgatttagcactcgcacgttggggtttgggggggagaggagcccagcactgggattccgaggtgtttccagttcggtgatcagcactgaacacagaggactcaccatggtagttttggctgagcttgggttctccgttgttggtaacttttaaaggtgtccagtgtgaggtgcggctgagtggagtcgtagggaggtacggcgtttacgtccgacgtcccggttggggggtcccaaggacgtaccgtccttccgtgtcggacncgtccttcgnggtcctcgaccgtacacggacaacgaccaaacgtactaggtcggtacgggtttccgggtcccggaccgagggtacccgtacggggaacgggggacggggtccgtgggtaacgggttgggtcctacggtacgttctaagttttacgcgtttaggtattacgtttaccgaataacgtaccgtacgaccgtagaccgtccggtaggacggtacgtcttaacctacctacgtaccgtaccgacggtacgtaacgtacgtaacgtaacgtacgttacttatacaagtacgaacacgtagagacggcgaacgacgaccgtccgtctacgtacgtgacgacggaagacgtacggcggcggtacgtacggttcgttaggttagttacgcgttttttttttttttacggacgttacggtcgggtaccggtaacccggg

SEQ ID NO: 44315 - DNA, 811 bp, Homo sapiens
  misc_feature: GYAE6OF01BQ41D.44.55.E11.1.454.CMB.1.raw
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (657)..(657): a, c, t, g, unknown or other
  misc_feature (657)..(657): n is a, c, g, or t
tcagacagtatatacacgaccggtgctcgatttagcactcgcacgttgggtttgggggggagaggagcccagcactgggattccgaggtgtttccattcggtgatcagcactgaacacagaggacctcacctagtggtagttttggctgagtccgttgggttccttccgttagtttaggttaaccgtttttaaaaggtcgttcccgtaaggttggtaggtagggttggccggcttggagtgggacgttcggtaggggagggtaggtccgttaacgtcccgacgtccgggttacggggaacggttcccgtaggacggtacctccgtccgttgaggtcgacggttcgtacgtggttacttaccgtaccttcgtaaccgtacctagttcgactcgttanccgtacgtccggggtaccnccgtacggcctaccggaagggtaccgggaagggcggtgggaacgggtttcgggaacgtacgttaacgttagtaggttaggtacgtaggtaacgaaaggtaagtaaaagttaagtatacgtacgtacgtaacggtaccgtccggacgggtaacgtccgtaacttcgaactacgtaccgaacgaacgtaactaactaacgttaaccgaagtaaccgtacggtaccttacgtatacgaacgtaanaacgttacgaaccgagtacctaagggccgaacgggtaccgtaccgggtacgtaacccgttggtaacgttacggttacttaccgggtacggttacggacgtaaaccgttaggtaactttaggttaaaccgttcttaaacccgtcgttaaacccgg

SEQ ID NO: 44316 - DNA, 745 bp, Homo sapiens
  misc_feature: GYAE6OF01BQQKF.44.55.E11.1.454.CMB.1.raw
  modified_base (185)..(185): a, c, t, g, unknown or other
  misc_feature (185)..(185): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggactttaaaggtgtccagtgngaggtgcggctgatggagtctgggaggaggcttagtccagtccgtgggggtcccagcgactctccgtgtcgcagcctcgtggctccgaccgtnagcagccaactacntggtgttcggccgacgcggtcaccgtagggacggggtctagggagtcgggtacnctagtctagtttatacgtggtntacttcgaactctaacgacgaccagtacncggttaggaacgggtcctaagttcccgaaccagttaacccgtaccggaacgggaacctaaacgttccggaacgtaaaccgttaacccgggttttaatacgtttaaacgaacttaccggaaaccgttaccggacgtaagggtaccggaacgaaccggtaaccgtacgggtaaccccgttaagttaccgttaacgttcgtacgggaaccggtaacgtaccggtaaacgggttcccgggtaccgtacccgggttaacggttcgggtttacgggttttaaacctttacgggttttacggtttacccggtttaaaggttcccggggtcgggggttaaccccccggtaacgggg

SEQ ID NO: 44317 - DNA, 919 bp, Homo sapiens
  misc_feature: GYAE6OF01ED9V4.44.55.E11.1.454.CMB.1.raw
tcagacagtatatacacgaccggtgctcgatttagcactcgcacgttggggtttggggggggagaggagcccagcactgggattccgaggtgtttccattcggtgatcagcactgaacacagaggactcaccatgggagttttggctgagcttgggttctccttgttggtaacttttaaaaggtgtccagtgtgaggtgcggctgagtggtagtcgtgggaggaggtcgttacgtccgacggcccggttacggggggtcccaggacgacttccttcctggtgcacgtccttcgtcgggcctccaccgtcgacgcacgactaaactacacgtggtaggtttccggggtaccccgcggacgggtccgtaccgggaaaggggggtaacggggtcgtaggggtacggttcggggtaccttacgtacgtttacgtaattttagtacggttggttagttactttaccgaactaacgtttaccgtaaccggtcgtaacgtacccgtttacccgggtaagggtaaacccggggacccgttaactttacccaaacccttaccgtttaccccgtaacggggtaaaccgggtaaaccgttaaacccgtttacccgggaaaacgggttaaccctttaacccgggtttttaactttaccgttaaaaccggaaaacgtttacccggaaaaccttaaaccccgggttaggaacgggaaccgggtcccgaaaaccggtcccgggaccgggtttaaccgttaccgtttaacgttaccggtgggttaacggaccggtaaaggtaaccggtaccggggttaccgggccgggtttaaccggtacggggttaggttttaacgggttttaatttccggggttttacgttttaaccggaccgggttttcggggacccgggggtcccggttaaaacccggggg

SEQ ID NO: 44318 - DNA, 788 bp, Homo sapiens
  misc_feature: GYAE6OF01AYQ3O.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggtagttttggctgagctgggttctccttgttggtaacttttaaaaggtgtcagtgtgaggtgcggctgatggagtcgtgggaggaggtcttacgtccgaggccggtggggggtacccaggacgtacctccgtcctggtcgcacgtcccgtcgtcgggcctccgaccgtcacgcaacgacctaaactacagttggtaggttccgggtcccgccgacggtccgtaccggagggggaacggggtcgtgggacggttcgggtcctacgtaacgttcttaattttacgtacgttggttagttactttacgaactaacttaccgtaccgtacgtaacggtacccgtaccggtaacgggaaccgggtcctacgttacccaaccgtacttacccgtaaccgggaacgggtaacctaaacgtttaacccgaaagggtaaacccgtttaacggttttaatccgttaaactaaactaccgtaaaccgtacgtaggaacgggcgggtaacccgaacggtacccggtaccggtaccgtttacttaagttaccgtcggacggtaacgaaacggtaccgtaaccgggtccggtcgttccggagggttagtttacgggttatttacggtttcgttacgtacgtttcgggacggggtcccgtaaaccgggg

SEQ ID NO: 44319 - DNA, 806 bp, Homo sapiens
  misc_feature: GYAE6OF01CGTPX.44.55.E11.1.454.CMB.1.raw
  modified_base (665)..(665): a, c, t, g, unknown or other
  misc_feature (665)..(665): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtgggaggaggtcttagtcccgaggtccggtgggggtcccaggtacgacctctcctgtgcagtcctgtcgggcctcaccgtcagcacgactaaactacagtcggtacggttcggtcccgccgaggtcccgtaccggaagggggtaacggggccgttagggacggttcgggtcctacgtacggttaccttaagttttaacctaccggttggtattacgttttaccaacctacgttaccgtacgacctaacgtaccgttccggtaaggaaccgggtcccgtaatttccccgaaacttacctaccgtaaccggaagggtaaccctaaacgtaccgaaaggtaacccttacggtttaataccgtttaaacgaaagtaccggtaaacctaaccgttacggaacgggtacgacccggtaaccggacccgtaacccgggttccttaacccgttagtttaacccggngttaccggaaccgtaacggaacccgtaaggggttcccgaaccggttacgggtaacccgggttaggtttacggttttaacctttcggttttcgggttaccttaacgggtttcccgggtaaaggggtcccgttaaacccgggg

SEQ ID NO: 44320 - DNA, 779 bp, Homo sapiens
  misc_feature: GYAE6OF01EZK5T.44.55.E11.1.454.CMB.1.raw
tcagacagtatatacacgaccggtgctcgattttagcactcgcacggtttgggtttggggggggagaggagcccagcacttgggattccggaggtgtttccagttcggtgatcagcactgaacacagaggactcaccatggtagttttgctgagtcgtcggtttctcgttgttcggtaacttttaaaggtcgtcagtgtgaggtgcgactgagtcggagtcgtagggaggcgttcttaggccgacgtccggtcggggtacacgtacgtcttctccgtgtgacgcgtccgttcggcggtcctccgtacccggtacaggtccgacgactaccgttacgtagtaggtacggtttcgggacccacggtaggtcccgtacgggaagggtaacgggtcgttacgggtagtcgtcccgttatacggtacttacgtttagtcggttacggtacgttatttccggaatacgttaaccgtaacggtacaacggttcccgtttagggaaaccggttacgggtaccgttaacgttaacccgtacgttaccgtacccgtaacggggtaacgaacgttacgtaacccggagttaaccggttacgttacgtactaactaagtacgtaactacgtacgagacggtcaacgtaccggacgtttaacctagttacgttacgtacgaggtaaccgttaacgaggaccgggttcgaccggttcgggtaacgtttcgggttaaattccggttttcttaagggtttcctacgtttcgggtaacggtccggttaacccgggg

SEQ ID NO: 44321 - DNA, 973 bp, Homo sapiens
  misc_feature: GYAE6OF01CXEPP.44.55.E11.1.454.CMB.1.raw
  modified_base (66)..(66): a, c, t, g, unknown or other
  misc_feature (66)..(66): n is a, c, g, or t
tcagacagtatatacacgaccggtgctcgatttagcactcgcacgttgggtttggggggagaggancccagcactgggattccgaggtgtttccattcggtgatcagcactagaacacagacggactcaacctatggtagttttcggctgaggcttgggttccttaccgtttggttcggtaaactttttaaaagggtcgtaccgtaggttggttaggagggttcgaccgggtctggtaacgtgggtagttcgtgggtaggacggtctttaacggtccgacggtcccggttggggggttccccaagacgtaccttccgttaccgttgtcgacgacgtccccgttgtacgggtccctaccggtccgtacgaacgtccgtaaccgtaaccgttaaccgttacggtacggtttacgggttaccggggtttacccgggtacccggtacccgtaaccgggtacccggtaaccgggggaacggggtaacggggttccggttacgggggtacggtttccgggtttaccgtaacggttaccggtttaacgtttaacgttttaacggttaacgggtttcggtttaacgtttacccgtttaacgtaaaccgttacccggtttaacgtaaccggttaccggtacccggttaaccggttaccgggttaacggtaaccgggttacccttacgttacccgtacccgttaccgttaccgtaaccggtaaccggtaacccgttaacgttaccgttaaacggtaaccgttttaacggtttaccgttaaccgttaacgtaaccgtaacgtaaccgttacggtacggtaaccggacgggtaaccgaaccggtaccggtaccgtacgttacgttacgttacggtacgtacgtacgtacgtacggtacggtaccggtcgtaccgttacgggttaccgtttgtttaacgttttcgttaccggttacggttaccggtcggtaccgggtcggtaccgg

SEQ ID NO: 44322 - DNA, 904 bp, Homo sapiens
  misc_feature: GYAE6OF01DPE0C.44.55.E11.1.454.CMB.1.raw
tcagacagtatatacacgaccggtgctcgatttagcactcgcacgttgggtttgggggggagaggagcccagcactgggattccgaggtgtttccagttcggtgatcagcactgaacacagaggactcaccatggtagttttggctgagtcgttgggttcttccgtttggttaggtaacgttttaaaaggtcgtccgtaggtgtggaggtggcggcgtgagtggtagtcgtgggaggacggtcttagtcccgaggcccgggttcggggggtacccagacgtacctcgtccgtgtcgcgtacgcccgttgtcggccttaccgacccgtagacgacgagaacctaacttaacagttcggttacgggtttccgggtaccccgccggtaccggtacccggttaccggggaaacggggggaacggggttcggttacggggtaacgggtttcgggttaccgttaccgtacgtttaaccgttagtttttaacgtacggttacggtttacgttacgtttaaccaaccttaaccgttaaccgtaaccggtaaccgtaacggtccccggtaacgggttaacgggaacccgggttaccgtaaccgtttaacccgtaacccgtaaccgttccccgtaaccgggaaagggtaaaccctaacggtttacccgaaaacgggttacccgtttaacggttaactttaccggtaactaaacgtaccgaaacgttaccgtaggacgtacgggaaccgtaccggaccgtaccgggtaccttacgtattacggtacgacggaaccgtaagtaaccggtaggtacccgggccggtacggttacgggttagttttacggttttactttaccggtttcggttttaccgggaccttttcgggggaccgggtacccggttaaccccgggg

SEQ ID NO: 44323 - DNA, 840 bp, Homo sapiens
  misc_feature: GYAE6OF01AM3F1.44.55.E11.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (361)..(361): a, c, t, g, unknown or other
  misc_feature (361)..(361): n is a, c, g, or t
  modified_base (408)..(408): a, c, t, g, unknown or other
  misc_feature (408)..(408): n is a, c, g, or t
tcagacagtatatacacgaccggtgctcgatttagcactcgcacgtttgggtttggggggggagaggagcccagcactgggattccgaggtgtttccattcggtgatcagcactgaacacagaggactcaccatgggtagtttttgggctggagcggtcggttcgtccttaggtcgactttaaaagtgcagtgtgagtgcgntagcnggngtctagggaggtacgtcttacgccaggccggttcgggggaccagacgtctcttcctggacgaccgtgtcctgtcgggcctacgacccgtggagtcacgtacaaacctagtagtggtacgggtttccgggcctacccggagccggaccgggngggggtaaccggtcgtagggtaccggtcggggtcctaactacggttnttaactttacgtaaccggttggttaccttacttacaaccttacgtaccgacgccgtacgggacctttaccgggaaggtaccgggcctttaacgttccgaacccttccgttacctaccggggtaacaaccttaacccgtaacggtaacgggtaaccctttaccggttttaaccgtacttaaaccgaaacggttaccaaacccggtgtaaagggtacgggaacggaccgtaaccgggtacccacccggggttcgttaaaccgttaaccgtttcggagggttaaccttaccgggaaccggaaggttaccggggtaccccgggggtacggttcccgggtttaaaggttcgggttttaaacggttttacgtttaccggtttcgggttttaccgtacggggtttacccgggggtacccgggtacccggttaacccggg

SEQ ID NO: 44324 - DNA, 714 bp, Homo sapiens
  misc_feature: GYAE6OF01A1CG1.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggtagtttggctgagctggttctccttgttggtacttttaaaaggtgtcagtgtgaggtgcggctgagtggagtcgtgggaggacggtcttagtccgacggtccggtcggggggtccccaggacgtacctccgttccgtgtcgcacgtccgttcggtcgggccttccgaccgtcacgaccacgacctaacgtactagtgtacggttcgggtccgccgacggccgtaccggaggggacgggtcgtagggtacggtcggtctcgtacgttacttatttagtacggtggttagttacttacaacgtactaacgtacgacgtacgtaccgttaccgggtaaggaccggtccgtacttaccgaactcgttccgaacggaggtaacctaacgttaccgaaggttaaccgttacgtttactacgtaaaccaaagtacaaccgtcgaggacgtaacggacccgaacggtcgacccggtccttaacttacgttacgcgaaggactaacgtacgacgggtccgaccgtgggtaggttcgttaggtttattccggtttagtacggtaccttcgggtaccgggcggtaaccggg

SEQ ID NO: 44325 - DNA, 752 bp, Homo sapiens
  misc_feature: GYAE6OF01AW9B7.44.55.E11.1.454.CMB.1.raw
  modified_base (214)..(214): a, c, t, g, unknown or other
  misc_feature (214)..(214): n is a, c, g, or t
  modified_base (584)..(584): a, c, t, g, unknown or other
  misc_feature (584)..(584): n is a, c, g, or t
tcagacagtatatacacgaccggtgctcgatttagcactcgcacggttgggggtttgggggggagaggagcccagcactgggagttccgaggtgttttccatttcggtgatcagcactgaacacagaggactcaccatggtagttttggctggagtcgttcgggtttcttcctttgtttggtaacttttaaaaggtcgtcagtgtgaggtgcgntgtgtggagtcgtgggaggaggtcttacgtcgcggtccggtcgggggtaccaggacgtactccgtctgtcgcgtcgtccgttcgtcgggtcctccgtaccggtacgacgcgaacgactaacctacgtacgtcggtacggtttccgggtcccgtaccggtacggtaccggtaccgggtaaggggggtacggggtcggtaggggtacgggttcgggttccgtagtacggttacttagttttacttcgttggttagtactttactactaataacctaccgacacggtaccgtcggaaggtaaccggtccgtacttaccactactcccgtacgacgtaactacgtacgaacgttacgttacgtttatacttaanaacgtacaacctacgcgagggaacggccgaaacgtcgtccgttacgttacttacgttacgtaggacggacgacaccggtagtccggcggttacgtcgggttaacgttttggttactttaacggtttccgttacggttaccggttcgggttccgggaccggtacccggg

SEQ ID NO: 44326 - DNA, 797 bp, Homo sapiens
  misc_feature: GYAE6OF01C6XPR.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcacatggtagtttggctgagtcgtgggttcttccgttgttaggtaacgtttaaaaggtgtccgagtgtggaggtgcggcttgagtggagtcgtagggaggagtcttacgtccgacgggtccggtacggggggtacccaagacgtaccgtccgtccgttggtacgaccacggtcccgttcggtccggggtacccttaccggacccggttacgaaggaccaacggtaacctaaaaccgtacgtaagtcggggtaacgggtttcccggggaccccggaccgtacgggtaccgaccggggaaagggggtaacgggtcggtacgggtaggttcgggttacgtccgtaagttaccgttagtttaacgtacggttaggtacgttaacgttacaactaacgtacgacgtaccgaacgtccgtacggtaggaaccggtctacgtccacgtcttacgacgaaggtaacctaacgtacgaacgggtaacttaacggttactactaacaaacggtacaaccgacgttaggaaggaaccggacgacgaaccggtcccgtacgtaacttacgtagcgtacggacgtaacgaccggtaagtcccggggagtacgttacgggtaagtttaggtttactttacggttcgggttaagtacccgtcgggtaccgggtaccggtacccggg

SEQ ID NO: 44327 - DNA, 687 bp, Homo sapiens
  misc_feature: GYAE6OF01AQCPU.44.55.E11.1.454.CMB.1.raw
  modified_base (546)..(546): a, c, t, g, unknown or other
  misc_feature (546)..(546): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcagccgtcgtcggggacccccgggcgacgggggtccaccacttccttcttggttcgtgggaaggtaacgtccaatatcggattcttatcctgtactactggtagtcgggactcccgaggccaccggccccccgacttcctactctactcgcctactaactcgacgccggtccctcgacgggtccctacggcccgtattcctacgtcggcctaccgtacgtcgtcggactacgtacgacggcctaccgtcggtacctacgtccgttgccttccgtacctaggttctagggaaggtctaggacgtcttagtactttaccgtcgttaggtgactacggcgtaaggtggtacgtcgaaccggnggtaacccgggtacggttcgggtcgggttcgggttaccgggacggggtaaccggtaccggttacgggttccggtaaccggttcggttaacggacccggtaaccggacccggtacggtccctcccgggtaccccggttccgg

SEQ ID NO: 44328 - DNA, 735 bp, Homo sapiens
  misc_feature: GYAE6OF01AE3B9.44.55.E11.1.454.CMB.1.raw
  modified_base (201)..(201): a, c, t, g, unknown or other
  misc_feature (201)..(201): n is a, c, g, or t
  modified_base (473)..(473): a, c, t, g, unknown or other
  misc_feature (473)..(473): n is a, c, g, or t
tcagacagtatatacacgaccggtgctcgatttagcactcgcacgttgggtttggggggagaggagcccagcactgggacttccgaggtgtttccattcggtagatcagcactgaacacagaggactcacatggtagtttggcgtgagcttgggttctccttgttggtaacttttaaaggtgtcctagtgtgaggtgcggntgagtggagtcgtgggaggaggtcgttagccaggtccggtcggggggtccagagactcctcctgtcgcgacgcctcgtggcctcaccgtcagacagaccaatacgtatggtacgggttcgggaccccgcgacggtccgtaccgggaagggggaggggtaccgtgggtagggttacgggttctacgtagttactaacttttagtacgttggtacgttacttactacgtactaacgtcgacaacgtaccgtcggtaggacggtccgtactaccnctactaccgtacggagtacctattccgaaaggtaaccggtttacttaacgttacctaaactaacgtaccgaagtacggtggaaaccgggtaggaccggaaccggaacggtccggtaccgttaacgttactaccggtgtaacgggactagtaaccgacgggttacccggcggttccgttagggggtttcgtttagggtttaacttttcggttttacgttacggtaccggggtttccggtcgggggttacccgtaacccggggg

SEQ ID NO: 44329 - DNA, 791 bp, Homo sapiens
  misc_feature: GYAE6OF01D0Z8T.44.55.E11.1.454.CMB.1.raw
  modified_base (294)..(294): a, c, t, g, unknown or other
  misc_feature (294)..(294): n is a, c, g, or t
  modified_base (610)..(610): a, c, t, g, unknown or other
  misc_feature (610)..(610): n is a, c, g, or t
tcagacagtatatacacgaccggtgctcgatttagcactcgcacgttgggtttggggggggagaggagcccagcactgggattccgaggtgtttccattcggtgatcagcactgaacacagagactcaccatggtagttttggctgagtcgttgggttcttccgttggtttacggtaacgtttttaaaaaggtcgtaccgagttggtggaggtggcggtctgagtggagtcgtaggaggagtcttacgtcacggccggtcgggggtcccagacgtacctccgtcctggtcgacncgtcctcgtcggcctccgaccgtcgacgcaacgacctaactacgtagtcggtacggttccggggtacccgaccgaccgggcccgtaaccgggacggggggtaacggtcggtagggtacggttcggtaccgtacgtacggttacttaacgtttagtaccggttggttacgttacttaccaactacgtaaccgtacggaccgtaaccgtaccggtacgggtacggtaaaccgggtccttaacgttacccgaaccttcgtaacccgtaaccggaggtaaaccttaacgtacggtaaaccggttaacttaccggtttaanaaccttaaacgtaacgtaacggtaaacctaccgtagggaacgtacgggaccaacggtccgaccgggttacttaccggttatacggtgtacgacgtaagaccgtcggacggtccgtagtcgggtacgtttcgttaagttcggtttcgtagtacccggtttacggcgggtacccgtaaccggg

SEQ ID NO: 44330 - DNA, 987 bp, Homo sapiens
  misc_feature: GYAE6OF01BYQXR.44.55.E11.1.454.CMB.1.raw
tcagacagtatatacacgaccggtgctcgatttagcactcgcacgtttgggtttggggggggagaggagcccagcactgggattccgaggtgtttccattcggtgatcagcactgaacacagaggactcaccatggtagttttggctgagcttgggttctccttgttggacttttaaaaggtgtccagtgtgaggtgcggctgatggagtctgggaggaggtcttagtccgagccggtcggggggtcccagacgacctctccgtgtgcagtcctcgtggctccgaccgtcacgcgacgacaactacagttacggtacggttccggggtacccgccgacgggtccgtacccgggaaggggggtaacggggtcgttaggggtacggttcgggttacgttaccgtaagttccgtttaagtttttaacgtaacggtttagggtttacgttaacgttttacccgaaacttaaacgtttaaacccgttaaccggtacgtaaacgggtacccgttaccggggttaacgggtaaacccggggtacccgtttaacgtttaaccccgaacccttacgttacccgttaccgggaaacgggttaaccctaaaacgtttacccggaaacgggttaaaccgttttaaaccgggtttttaacttaaccgtttaaaccgaaaagttaaccggaaaaccgtaaacccgttaggaaacggggacgtaccgggtaaacccggtaacccggtaacccggggtttacccgttactttaaacggttttaccggtaacgggtacggtaacccgggaaaacggttaaacccgtaaacgggggggtttcccgggccgggttacccgggtttaacggggggttaaacggttttttaacgggttttttaaacgttttttaaccgggtttttacccggggttttaacgggtttaaaccccgggtttttcccggggggttaccgggggtaaccccggtttaaaacccccggggggg

SEQ ID NO: 44331 - DNA, 715 bp, Homo sapiens
  misc_feature: GYAE6OF01BEZ04.44.55.E11.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (610)..(610): a, c, t, g, unknown or other
  misc_feature (610)..(610): n is a, c, g, or t
tcagacagtatatacacgaccggtgctcgatttagcactcgcacgttgggtttgggggggagaggagcccagcactgggattccgaggtgttccagttcggtgatcacgcacgtgaacacagaggactcaccatcggagttttggctgagccgggttctccttgtggtactttaaaaggtgtccagtgtgagtgngcgtgatggtagtctggaggcgcttacgtcagccgtgggggtcccagagctctcctggtncagcctntgggctcaccgtnacgcacgacaactacactagcggttcggaccgccgtacggcccttaccggaacggggtaaggggtccgtagggtacggttcgggtactccggtagtacctaatttccgtaacgtggttactaacgtttacaacgtactaacccgtacgtacgtacgtaaccgttacggtaggaaaccgggtccgtaaattcccgtaaacctaacgttcgtaacccgagggtaacttaaaccgtacccgaaacggtaacgtccgtttaattacgtactaaagtaacgtaactaaccgtggaactagggaccgaacgtaccgaccgtccggttaataccgttttacncggtacgccgaagtacccgtaggtcccggaggtcccgtaggtcggttaagttttacctggttttaccgtacggtactttggacccggggtcctaacgggtacccg

SEQ ID NO: 44332 - DNA, 790 bp, Homo sapiens
  misc_feature: GYAE6OF01B7H3K.44.55.E11.1.454.CMB.1.raw
  modified_base (194)..(194): a, c, t, g, unknown or other
  misc_feature (194)..(194): n is a, c, g, or t
tcagacagtatatacacgaccggtgctcgatttagcactcgcacggttggggtttgggggggagaggagcccagcactgggattccgaggtgtttccattcggtgatcagcactgaacacagaggactcaccatggagttttggctgagcgtgggttcttccttgttggtaacttttaaaggtcgtcagtgtgnggtgcggctgatggactcgtgggagagtcttacgtccgaggtccggtcgggggtcccaaggacgtaccttcgtcccgtggtcgcacgtccttcgtacgggtcctaccgtccggtcgacgacgacgtaacctaaccttaccgagtaggtacgggtttccgggccccgacggacggtccgtaaccgggacgggggtacgggttccggtagggtacggttcgggtcctacgtacgttactttagtttactacggtttggtacttagttaccaacttacggtactaaccgacgacgtaccttaccgggacggacggtccgtattaccgaaccctttgaacccgttcggaaacgttacccgtaaagtcccgtaaggttaacccttacggtttacttaccgtaagaaaccgttccaaacgttaacccggtggtaaccggacgggtacccgaacggttaccgtaccccgggttacttacgtttaagttacccggtggtaaccgacggttacaaacgggtcgtagcccgggttactacggggttattaccggttaattcgggttttacggtcctaccgggtagttcccgggaacccgtaccggg

SEQ ID NO: 44333 - DNA, 1058 bp, Homo sapiens
  misc_feature: GYAE6OF01BFH8E.44.55.E11.1.454.CMB.1.raw
  modified_base (149)..(149): a, c, t, g, unknown or other
  misc_feature (149)..(149): n is a, c, g, or t
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
tcagacagtatatacacgaccggtgctcgatttagcactcgcacgttgggtttgggggggagaggagcccagcacgtgggattccgaggtgtttccattcggtgatccagcactgaacacagaggactcaccatggtagttttggctgngctgggttctcttgttggtactttaaaggtntcagtgtgngtgcgntgatggagtcgtgggaggaggtcttacgtccgacgtcccgggttcggggggtacccaaggacgtaccttcccttccgtggtcgacgtaccgtcccgttcggtcggggaccttccgacccggtcgacgcaacggactaaaccgtacaagttcggtacggtttcgggtccccgaccggtacggtccgtaccgggaagggggaacggggtcgttaggggacggttgggttaccgtacgtacgtttcgttaacgtttttaacgttaccggtttggtttaacgttacctttttacgaaaccgtaactttaacccggtaacggtaaccggtaacggttaacccggttaaccggggttaaaccgggtaaccgggggttaccccgttaacgttacccgaaaccccgttaacgttaccccggttaaccggaaccggggttaaaccttaaaccccggtttaacccggaaacgggtttaaaaccccgtttaacgggtttttaaaccccgtttaccggtttttaaaacccgtaaaacgtttaaccggaaaaccccgtttaaacccggtaacgggtaaccgggtaaacgggtaaccccggtaaaccggggtaaacccccggttaccgggggttaccccgttttaagtttaacccggttttaaccggttcgggttaaccgggaacggtaaccggggttaaaccccggtaaccggggttcccgggtaaccgggttaccgggtttaacccggggtttaggggtttaaccgggtttttttaaacgttttaacccggttttttacgggttttaccgggttttaaccccgggtttccggggttaacccggggggttaaaccccgtttaaacccccggggggg

SEQ ID NO: 44334 - DNA, 664 bp, Homo sapiens
  misc_feature: GYAE6OF01CKX23.44.55.E11.1.454.CMB.1.raw
  modified_base (424)..(424): a, c, t, g, unknown or other
  misc_feature (424)..(424): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggaccccgggcgacgggggtcacctatcttcttgttcgtaggaacggtaacgtccaatacgtcggtatcttactcctgtacaacgtggtacgtcgggactccgaggccacccggccccctactccgttactctatcgactactatcgacgccgtccgtcgacggtcctcgcctcttctcgtcgcctacgagtctcggctacgtacgacgctacgtcgctactcgttnactctcgtagtcaggacgtagtcggtacgcgtagtacttacgtctggtcgcgtaagccgtaaggtcgggaactggaaccggtaccgggaccgggtacgggtcgggttacggggtttcggttacggggacggggtaaccgggtaccgttaacggggttacccggttaccgggttacccggttacggtacccggaaccggtacccggacggttccccgtccccgggtccccgtttacccggg

SEQ ID NO: 44335 - DNA, 831 bp, Homo sapiens
  misc_feature: GYAE6OF01ATESQ.44.55.E11.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
tcagacagtatatacacgaccggtgctcgatttagcactcgcacgttgggtttggggagcttcagctgtgggtagagaagacaggactcaggacgatctccagcatggccagccttccctcctcctcctccaccctcctcacctcactgtgcgtacgggtccgtcgggcccagtctgtgatgtctcacgccctaccctcgacgccgtcggccgggaccccgggngacgggtccacntctcgttgtgaggaagacgtacaagtacgtcgattctactccgtcgtacgtaacgtggtacgtccgggtacctcccgacggacccggtccccggaccccccgtacgttccctttacgtaccgttactacgtaccttaacgtaaccgtcgaccggcccgtccctaccggggtaccggtaccccgtcgtaccccgtacgtttccgtcccggtacggtaccctaccggtaacgtccggtacgtacctacgtaaaccggtacgtaccccgtaccggtacgtcccttaccgtttccttacggtacccttcgtaccgtacgttcggtagggagtacggtcggacgttcgtaacgttaaccttaccgggttatcggtagtaccgtaatccgggttaaggtcggtaacgtaacgggtaccggtaacgggtcccggggtaacgggttcggggttagggtaccccggggttcggggaaccggggtaaccgggttaaaccggttacggggttaccggtaacccggtttaggggtaaccccggtaccgggtaaccggtaacccccgggtaagggttccccccgttccccggtttccccggaacccgg

SEQ ID NO: 44336 - DNA, 526 bp, Homo sapiens
  misc_feature: GYAE6OF02GRIPW.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcacggcccccgactcccttatctatgctactaatcagcggccctcaggggtccctgcccgattctctggctccaagtctggcactacaggctacctggccatccttgatctccagtctgaggatgaggctgattactactgtgcagcatgggatgacagccggaacggcgtggggtgttcgggcggagggaccaaggttcggaccgtctaggtcacggcccgaaggcctcgccccctcgg

SEQ ID NO: 44337 - DNA, 539 bp, Homo sapiens
  misc_feature: GYAE6OF02HTIH8.44.55.E11.1.454.CMB.1.raw
  modified_base (345)..(345): a, c, t, g, unknown or other
  misc_feature (345)..(345): n is a, c, g, or t
  modified_base (472)..(472): a, c, t, g, unknown or other
  misc_feature (472)..(472): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgaggggaagggctgggagtgggtctcgagtcatttanactggtgatttcacatactacgcagactcgtgagggccattcaccatctccagggacaattccaggaacacggtttatcttacaaatgaacaacctgagaggcgacgacgacggccgtctattacgngtgcgagacaaggtcggcgctcggagtggttattagttcgtttgacgtttcgtggggcctaacgggg

SEQ ID NO: 44338 - DNA, 528 bp, Homo sapiens
  misc_feature: GYAE6OF02GFLKT.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctgggagtgggtctcagtcatttatactggtgatttcacatactacgcagactccgtgaaggccgattcaccatctccagggacaattccaggacacggttatcttcaatgaacaacctgagaggcgacgacacggccgtctattactgtgcgagacagtcggcgctggagttggttattattcgtttgacttcgtggggcctaacggg

SEQ ID NO: 44339 - DNA, 538 bp, Homo sapiens
  misc_feature: GYAE6OF02GBY8Y.44.55.E11.1.454.CMB.1.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
tcagacagtatatacacgaccggtgctcgatttagcactcgcacgttgggtttggggagcttcaggctgtgggtaggagaagacaggactcaggacgatctccagcatggccagcttccctctcctcctcaccctcctcactcactgtgcagggtcctgggcccagtctgtgatgtctcagccaccctcagcgtctgggaccccccgggnagggggtcaccatctcttgtctggaagagtccaatatcggatcttatcctgtcaactggtatcggggactcccaggcaccggcccccactccttanctatgctactaatcagcggccctcgacggggtcccctgcccgattcgtctggcctccaagtctggcactacgnggcctacctggccatcccttgactctccagtctgaggatgagctgatttacactgtncagcagtgggatgacaggccggaacggtgtgggtgttcgggcggacgggactaggttcgaccgtcgtaggtccagacccgtaaggcctaccggcccctccgg

SEQ ID NO: 44340 - DNA, 632 bp, Homo sapiens
  misc_feature: GYAE6OF02HUUSX.44.55.E11.1.454.CMB.1.raw
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (440)..(440): a, c, t, g, unknown or other
  misc_feature (440)..(440): n is a, c, g, or t
  modified_base (509)..(509): a, c, t, g, unknown or other
  misc_feature (509)..(509): n is a, c, g, or t
  modified_base (539)..(539): a, c, t, g, unknown or other
  misc_feature (539)..(539): n is a, c, g, or t
tcagacagtatatacacgaccggtgctcgatttagcactcgcacgttgggttgggggtaggggaggagcccacgcactgggagttccgtacggtggtttcctacttcggttggatcagcactgaacacagaggactcaccatggagtttggtctgagctgggttcgtccttgttggtacttttaaaaaggtaggtccagtggtgaggtgcggctgatggagtctgggaggagggcttagtccagccgtcgggggggtcccanaggactctcctgtgcagcctcgtgggctccaccgtcngcagcaacctaacatggtagttgggtcccgccagggctccgaaggggaaggggctggaggtgggtctcngtctatttatactggtgtatttcacattactacgcagtacctcggtaggaacggggccattccaccattccnccgaagggactaacttaccgaacggaactacggtttatacttacaaaacttgaaaccaacctggaaggnggaccgaacacgaccgccgttactagttangtgacgagactaggtccgggctacgtcggggaagtttgggtttaatttacgtttcggtttacctacggtttccggtgggggaccctaacgggg

SEQ ID NO: 44341 - DNA, 581 bp, Homo sapiens
  misc_feature: GYAE6OF02IET5M.44.55.E11.1.454.CMB.1.raw
  modified_base (509)..(509): a, c, t, g, unknown or other
  misc_feature (509)..(509): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcacgcctcgtgggcctcaccgtcagcagcaactacatgagttcgggtcccgccgaggcctccgaggggaggggctgggagtgggtctcagtctatttatactggtgtatttcaactataactacgcagacctccggtaggaacgggcctattccaccatcctcccgaagggacctaattccaaggtaacctacggtttatcttaacaaattcgaaaccactagagaggcgacgacaccgccgtactatactgngacgagacaaggtcggcgccgtcgggagttagttattactttcggttgacgtttcgtggggacctaacgggg

SEQ ID NO: 44342 - DNA, 801 bp, Homo sapiens
  misc_feature: GYAE6OF02HBKZY.44.55.E11.1.454.CMB.1.raw
  modified_base (351)..(351): a, c, t, g, unknown or other
  misc_feature (351)..(351): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggcctcaccgtcagcagcaactacatgagttgggtcccgccaggcctccgaggggaaggggctgggagtgggtctcgagtcatttanactggtgatttcactatactacgcaagtacctccgtaggaacgggcccgtaatttaccgaccctatcccgtaccgaacggggtaacctaaacgtttcccgaaaggggtaaacccttaaaccgggtttttacttaacccgtttaaccgtaaaaacgttacggtaaaaacccgtaaaccccgtttagggaaacggaacgggggacccgtaaacccgggaaccgaacccggggtccccggtttacgtttaaacgtttaaaccgttcggtttaccgggaccggtaacgggtaaccgtaaacggggtttccccggggaaccggttacccggttaccgggggtaaacgggttttacgggttttaaacgtttttaacgggtttttcccgggttttacgggttaaacccggtttttcccgggtttacgggggggtaccccccttaaaacccggggggg

SEQ ID NO: 44343 - DNA, 618 bp, Homo sapiens
  misc_feature: GYAE6OF02HC4HB.44.55.E11.1.454.CMB.1.raw
  modified_base (360)..(360): a, c, t, g, unknown or other
  misc_feature (360)..(360): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttcgggtccgccgaggcctccgaggggaagggcgtgggaggtgggtctcgagtctatttatactggtntatttcactatactacgcagactccggtaggaacgggccgtattccacctactcctacgagggacaagttccgaaggtaactacggtttactcttaacaaatcgaaacactgaaggacggacgaccgacgaccggtaccgtcttaagttacctggtcgacggacgacgacgggtccggacggtcgtacgggtaggttaggttttaatttacgtttcggtttacggaccgtttcgggttacggggacccgtaaccgggg

SEQ ID NO: 44344 - DNA, 644 bp, Homo sapiens
  misc_feature: GYAE6OF02GB7F8.44.55.E11.1.454.CMB.1.raw
  modified_base (361)..(361): a, c, t, g, unknown or other
  misc_feature (361)..(361): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtctcggggaccccccgggcgagggggtcaccatctcttgttctggaagattccaatagtcggatcttatcctgtcaactggtatcggggactcccgagcaccgcccccgactccttatctagtctctactaactcgacgccgtccctcgacggggtcccctgtacccgnttcctctacggtctccgaagtctcggtctactacgacggtcctaccgtcgcctactccttgacttcctcgtcgtctagagtatcggacggtctaggtattacgtcgtgtcgaccagtcaggttacggcgttacgacgtacgccgggaacggtcgttcggggtacgggtttcggaccggggtacggaaccgttaaacggtttccgggaacccggtttacggttaaccgggttccgaacgggtccccggtaaggtcccgttacccggcccccggtttaacccggg

SEQ ID NO: 44345 - DNA, 584 bp, Homo sapiens
  misc_feature: GYAE6OF02H4X63.44.55.E11.1.454.CMB.1.raw
  modified_base (351)..(351): a, c, t, g, unknown or other
  misc_feature (351)..(351): n is a, c, g, or t
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtcccgccaggctccgaggggaaggggctgggaggtgggtctcgagtcattttanacgttggtgtattttcactattactacgcagactccgtggaacgggccgtattccgaccatcctccgagggactaattccgaggaacctacggtttatacttacaaatgaacactgagaggcgaacgacgaccggccgtacttattactggtacgcgagacaaggtcggcgtacgtcgggagttggttatttacgttcggtttacgtacgtttcggcggggtacctaacgggg

SEQ ID NO: 44346 - DNA, 795 bp, Homo sapiens
  misc_feature: GYAE6OF02J30L6.44.55.E11.1.454.CMB.1.raw
  modified_base (373)..(373): a, c, t, g, unknown or other
  misc_feature (373)..(373): n is a, c, g, or t
tcagacagtatatacacgaccggtgctcgatttagcactcgcacgttgggtttggggggagaggagcccagcactgggattccgaggtgtttccattcggtgatcagcactgaacacagaggactcaccatggtagtttggctgagtctggttctccttgttaggtaacttttaaaggtgtccagtgtgaggtgcggctgagtggagtcgtggaggaggtcttacgtccgacggtccgtcgggggtcccagacgtacctctccgtgtcgccgacgtccgttcgtcggtcctccgaccgtcacgcaacgactaactactagtcggtcggttccggtcccgacgtacggccgtacggaggggacgggtcgtaggnggttcggtactcgtagttacttagttagtacgtggtattactttacgacttacgtacgtacgacgtaacgtaccgtccggtaacggtaccgggtacctacttaccgaacccgtacgttacccgtaaccggtaaacgggtaaaccttaaccgttaaccggaaacggttaaaccgtttaacgtttacttaaccgttaaacaaacgttaaccgaaacctaaccggtaggaaccggtaacgggtaacccgaaccggtaccgttaccggtaccgtttaacgtaaccgttacgtggtaaccgaccggtaaggtaccgtaacgggttccgtaccggtttacgttaacgggttaagttttacggttaacttttacggtttaccggttacgtaccggtttaccgggtacccgggtaaccggttaacccggg

SEQ ID NO: 44347 - DNA, 587 bp, Homo sapiens
  misc_feature: GYAE6OF02IAPCV.44.55.E11.1.454.CMB.1.raw
  modified_base (302)..(302): a, c, t, g, unknown or other
  misc_feature (302)..(302): n is a, c, g, or t
  modified_base (424)..(424): a, c, t, g, unknown or other
  misc_feature (424)..(424): n is a, c, g, or t
  modified_base (493)..(493): a, c, t, g, unknown or other
  misc_feature (493)..(493): n is a, c, g, or t
  modified_base (537)..(537): a, c, t, g, unknown or other
  misc_feature (537)..(537): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctgggaggaggcttagtccagccgtgggggtcccagagactctcctgtgcagcctctggattcaccttcagtagctactggatgcacgtgggtccnccaagccgtccgagggaagggctgggtgtgggtctcgtacgtattaagtagtgagtgggatagcaacgaagcgtacggcggactccggtaggacggccgtactcacatctacccgagacganaaccgacaaacgacacgcttgtactctgacaaagtgaactagtcgtagagacgaccgtagacgacggtnttagtacgtacttacgtggtagaccgaaggaccgggttccgggngggttacggggacgggtttacggggtaggttcggaccgtagttaacccgg

SEQ ID NO: 44348 - DNA, 551 bp, Homo sapiens
  misc_feature: GYAE6OF02GYF9U.44.55.E11.1.454.CMB.1.raw
  modified_base (346)..(346): a, c, t, g, unknown or other
  misc_feature (346)..(346): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtcccgccaggctccaggggaaggggctggagtgggtctcgagtcatttanactggtgatttcacatactacgcagactcgtgaagggccgattcaccatctcagggacaattccaggaacacggttatcttacaaatgaaccaacctgagaggcgaacgacaccggcgtctattactgtgcgagacaaggtccggcgctacgggaggttggttaattacgttcggtttgacctttcgtcgggggacctaacgggg

SEQ ID NO: 44349 - DNA, 664 bp, Homo sapiens
  misc_feature: GYAE6OF02HOGW8.44.55.E11.1.454.CMB.1.raw
tcagacagtatatacacgaccggtgctcgatttagcactcgcacgttgggtttgggggggaggagggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagccgtggggggtcccagagactctcctgtgcagcctgtgggctcaccgtcagcagcaactacatgagttggcccgcaggctccgagggagggctggagtgggtctcgaggtctagtttatacgtggtgtaatttcgactatactacgactagactccgtagaacgggccagttcacctatctaccgagggacaagttcccaagggtaacctacgggtttaatccgtttaaccaaagttacgaaacctaaaccgtgaaacggacggtaccggaaccgtacgaacccggggtaccttaccgtaatttacgtcggtacggaccgaaggacgaaacggttccggggaccgaccgttacggggtaaggtttaccgggttttaatttaacgtttccggttttaggaacccttttcgggtaggggggtacccctaaaccgggggg

SEQ ID NO: 44350 - DNA, 593 bp, Homo sapiens
  misc_feature: GYAE6OF02JD7U2.44.55.E11.1.454.CMB.1.raw
  modified_base (209)..(209): a, c, t, g, unknown or other
  misc_feature (209)..(209): n is a, c, g, or t
tcagacagtatatacacgaccggtgctcgatttagcactcgcacgttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtgtcgtgggggcccccggggnaggagggtcaccatctcctgcacgtgggagcagactccaacagtcgggacagattctgatgtccactggtaacccaacaccttccaggaaccacgacccccaaactcctacactctttaggaacaactactccggccctcgacggggtccctgcccgtatttctctcggcctaccgaagtcctggcactacgacggtcctaccgtcgggaccctagttcccgttgaacttcctacccagttccttaggaggtagtcggaggtcctaggtaactttactacgtgtcgactagctagtgggatcggacgagaccgggaacggtcgttggggtcggttccgggagggacggaacctaggttccggacccgttcgtaggtccaaccgg

SEQ ID NO: 44351 - DNA, 636 bp, Homo sapiens
  misc_feature: GYAE6OF02INPTG.44.55.E11.1.454.CMB.1.raw
tcagacagtatatacacgaccggtgctcgatttagcactcgcacgttggggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtgggggaggcttagtccagccgtggggggtcccagagactctcctgtgcagcctcgtgggctcaccgtcagcagcaactacatgagttcggggtccgccgaggcctccgaggggaaggggctgggaggtgggtctcgacgttattaatagtgagtgggagtagacacaagctacggcggactccgtaggaacgggccgattcaccatcctacagacgaccaacgaccaaagaaccacgctagtactctagaacaaagtcgaactgtctaggacgacgcccggaagggacctaacgggtcttagggttagttaacgtttacgtggtacggaacgtaaacgggtacgggtcccggggttagggaccggggggttacggggtttacgggggggtactttagggacccttaacgttaacccgttaacccgg

SEQ ID NO: 44352 - DNA, 741 bp, Homo sapiens
  misc_feature: GYAE6OF02JWTOU.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagccttccctctcctcctcaccctcctcactcactgtgcacgggtcctcgggcccagtctgtgatgtctcacgcccaccctcacgcgtccgtccggggacccccgggcggacgggggtccaaccgtacgtccttcgtttcggttcgtagggaaacggtaacgtaccaaagttagtcggtacttctttatccgtacgtaccgtaacgttcggtacgtaccggggtacctcccgacggacccgaccccggcccccgtactccttaacgtccttaacgtcgtacctactaacgtccgacggtcccggaccctcggtaccggggttccctacggtacccgtactttccgtcgtcggtaccttaccgtacgtcgtcggaacctacgtacgacgtcctaccgtccgaccttacttccgttctacttcctaccgtacgttccgtaggagtacgtcggtacgtcgttacgtacttacgtacgtcgtacgccgtagtacgtaggtacggagtacgacgtacggtaaccgggacggttcggtgggttcgggtacggacgggtacggtaacggtacggttccgggtacgttaccggtacggtaccgaccggtaccgtacggtcccgtcccgtacccgtaccg

SEQ ID NO: 44353 - DNA, 677 bp, Homo sapiens
  misc_feature: GYAE6OF02JQHT3.44.55.E11.1.454.CMB.1.raw
  modified_base (310)..(310): a, c, t, g, unknown or other
  misc_feature (310)..(310): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagtttgggctgagctgggttttcctcgttgctcttttaagaggtgtccagtgtcaggtgcagctggtgagtcgtgggggaggcgtggtccagcctggggaggtccctgacgactctcctgtgcagcgtctggattccaccttcagtacctagtcggcatcgacacgtcgggtcccnccgaggcctccgaggccgaaggggtctagggaggtgggtcgtacctaacgttagtagtcggtatggtaagtagggaaaattaaagtaaaagttactagtgacgaagtaccgttccggtaaggaaccgggtccgtaattaccgaacctactccgtaccgaagacgtaaactaacttacccgaaacgaacgtaaccgtacgttagtaactacgtacgtaactaaagtacgaaaccgtacgtaccgtaacggaacggaccggacccgggtaacggaacccgaccgggtaccgttaggttacgtaaacgttaccgtgggtacgacggtacggactaagtacgtttacggtaacgttacctacccgtaaccg

SEQ ID NO: 44354 - DNA, 570 bp, Homo sapiens
  misc_feature: GYAE6OF02IKT8I.44.55.E11.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagacagtatatacacgaccggtgctcgatttagcactcgcacgttggggtttggggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagccgtggggggtcccagagactctcctgtgcagcctctgggctcaccgtcagcagcaactacatgagttcgggtccgccgaggcctccgaggggaacggggctgggagtcgggtctcgacgttactaacgaccgagtgggactatcgacttggttactcgaggccgccgtggaggccgtatcatcatcncaganacatcgacgaaacgcggtattattaacaagtnaacngtactaagagtacgagacacggctgtactagttagttgtgtgacgtacctttagtgtactttagacggtttaggggtatttacgtcgggtttacggccctacggacggtcgggg

SEQ ID NO: 44355 - DNA, 734 bp, Homo sapiens
  misc_feature: GYAE6OF02HUDV6.44.55.E11.1.454.CMB.1.raw
tcagacagtatatacacgaccggtgctcgatttagcactcgcacgttgggtttggggagcttcagctgtgggtagagaagacaggactcagacgatctccagcatggccagcttccctctcctcctcaccctcctcactcactgtgcaggtcctgggcccagtctgtgatgtctcagccaccctcagcgtctcggggaccccccgggcgacgggggtcaccatctcttgttctggaaggacgtccaatactcggatcttatcctgtcaactggtatcggggacctccgagccaccggcccccgactcccttatctatcgactactaatcagccgccctcgacgggtccctcgcccgtatttccgtcgtacgcctacctaagtccgtcggacctacgtacgacggtaccttacccgtcggcctaacttccgttacgtacttccctaccgtacggttcgtacggtaacgggagttacggacggtaccgttcggttaactttaaccgttaccgttgggttcgaccggtacgaccgtaaggttcgggtaacgtacggtaacggaccgggaacccggggtaacgggtacgggttacggggttcgggttaccgggggaccgggtaacggggtaaccggttaaaccgggttccgggtaaccccggtttaccggttaacgggtacccgtaccgggtaccccgtaaacgggtcccgttaccccggtcccccggttaccccggg

SEQ ID NO: 44356 - DNA, 664 bp, Homo sapiens
  misc_feature: GYAE6OF02HVWTW.44.55.E11.1.454.CMB.1.raw
  modified_base (368)..(368): a, c, t, g, unknown or other
  misc_feature (368)..(368): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctcgtgggctcaccgtcagcagcaactacatgagtcgggtccgccaggctccgaggggagggcgtgggaggtgggtctcgaggtctatttatacttggtgtattttcanatactacgcagactccgtaggaacggccattccacctatcctaccgaagggacctaaattccgaaggtaacctacggttttatccttaacgtaaatacgaaacctaaccgtggaaggtacgggaccgaaccgaaccgaccgggtcccgttacttaatttaccgtgtacggacgaacgaaccgtaaggtcccgggaccgttccggttaccggggtaaggttttacgggtttaagttttacgttttcgggtttttagacccgtttttcgggtacggggggtacccctaaacccggggg

SEQ ID NO: 44357 - DNA, 629 bp, Homo sapiens
  misc_feature: GYAE6OF02G8AZY.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggaccccccgggcagggggtcaccatctcttgttctggaaggagtccaatatcggatcttatcctgtcaactggtatcggggactcccgaggccgaccggcccccgactccttatctatcgctactaatcagcgccctgacgggtccctgccgtattctcgtgctccaagtctggctactacacggcctaccgtgggcctactccgttgacttcctccagttctggaggtatggtaggtcttaggtaactttaccgtacgttcgtacgccgagacaggttgggaacgttcggaccgtacgggacccgggtaacggtccggttgggggttcggttaccggggacggggtaaggggtaacccgttaagggttccggaccggttcccgttaggtccgtacggaccccgaaggtccctaccggtcccccgttaccgg

SEQ ID NO: 44358 - DNA, 190 bp, Homo sapiens
  misc_feature: GYAE6OF02H2RIS.44.55.E11.1.454.CMB.1.raw
  modified_base (190)..(190): a, c, t, g, unknown or other
  misc_feature (190)..(190): n is a, c, g, or t
tcagacagtatatacacgaccggtgctcgatttagcactcgcacgttgggtttgggactccagccttggtggtggggttttcggcggagggacccgactgaccgtcctaagtcagcccaaggctgccccctggtcactctgttcccaccctctctatatactgtctgagcgggctggcaaggcgcatagn

SEQ ID NO: 44359 - DNA, 644 bp, Homo sapiens
  misc_feature: GYAE6OF02I5ASK.44.55.E11.1.454.CMB.1.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtggttctccttgttggacttttaaaaggtgtccagtgtgaggtgcggctgatggagtctggaggaggcttagtccagccgtggggggtcccaggagactcctcctgtgcagcctctgggctcaccgtcagcagccaactacatgaggttcgggtcccgccgaggcctccggaggggaggggcgtgggngtgggtctcagtcattttancgttggtntatttcactatactacgcagtactccgtggaacggccgtaattccgaacctctcgtaccgagggactaacgttccgaaggtaacctacgggtttactctttaacaaagttcgaaacctaaccgtaggaacggacggtacgaaccgaacccgaccggtacccttacgttaccgttacgttcggtacgtcggaacgaaccgtcgggtacggccgtacggtacgggtaagttggtttatttacgtttcggtttgtaccgttcgggtacgggtccgtaacggg

SEQ ID NO: 44360 - DNA, 627 bp, Homo sapiens
  misc_feature: GYAE6OF02G3UFI.44.55.E11.1.454.CMB.1.raw
  modified_base (457)..(457): a, c, t, g, unknown or other
  misc_feature (457)..(457): n is a, c, g, or t
tcagacagtatatacacgaccggtgctcgatttagcactcgcacgttgggtttgggggggaggaggagcccagcactgggattccgaggtgtttccattcggtgatcagcactgaacacagaggactcaccatggagttttggctgagctgggttctccttgttggacttttaaaggtgtccagtgtgaggtgcggctgatggagtcgtggaggaggcttagtccagccgtgggggtcccagagactctctgtgcacgcctcgtggctcaccgtcacgcacgcaaactacatggtacggttcgggtcccgccgaggcctccgaggggaacgggctgggaggtcgggtctacgagttactatttatacgtggtagtatttcactatactagccagactcggtacgaaggtccattcgaccattccaccgaggtacaactccgaggtaactcggtttancgttcaaagtacaaccacgtagaaggtacgacggaaccgacgtaccggcttcttaattaccgtggacgtgaaccgtagaacggttcgggaccgtggtaccggtaggtttcgtttaagttacgtttcggtttacgtaacggttttcggtaccggggtaccctaaccggggg

SEQ ID NO: 44361 - DNA, 573 bp, Homo sapiens
  misc_feature: GYAE6OF02ICUKL.44.55.E11.1.454.CMB.1.raw
  modified_base (208)..(208): a, c, t, g, unknown or other
  misc_feature (208)..(208): n is a, c, g, or t
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcaggtcctgggcccagtctgtgatgtctcagccaccctcacgcgtctcgggacccccgggnacgggggtcaccatctcttgttctaggaaggaacgtcaatatcggatcttatcctgtcaactggtagtccggggactcccgaggccaccggccccccgatccttatctatgctactatcacgcgccctgacgggtcccngcccgattctcgtgctccaagtctgcactacagcctactcgcctatcctnactctctagtcgtgaggtactgacgtcgtagtatttacattgtgcagcgagtggatggaccagggtaccggaacggtcggtagggtcggtcgggacgggtacgggaacgtaacggttcggtacccggttccgtaggtcacggtacccgtaaggtccgtacccggtaccccgtccgg

SEQ ID NO: 44362 - DNA, 664 bp, Homo sapiens
  misc_feature: GYAE6OF02JZKU5.44.55.E11.1.454.CMB.1.raw
  modified_base (197)..(197): a, c, t, g, unknown or other
  misc_feature (197)..(197): n is a, c, g, or t
  modified_base (572)..(572): a, c, t, g, unknown or other
  misc_feature (572)..(572): n is a, c, g, or t
  modified_base (603)..(603): a, c, t, g, unknown or other
  misc_feature (603)..(603): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggntgatggagtctggaggagtcttagtccagccgtgggggtcccaggagactctcctgtcgcagcctcgtggtctccacgtcagcagcaactacagtcgtagttcggtcccgccaggtccaccggaaggggaacgggcgtgggaggtcgggttccacggtacgttaccgtagttttacgtaacgttggtcggttaattttaccgaacttaaactaccgtaccggtacctaaacggtacccgtacccggttagggaaccgggtccgtacgttaccaacccgttatcccgtacgtaacgggaactacgtaccgaaggtaccgttacgttactacttacaaattacgaaacccatagacgacggacacgcgacgaccgtntaactcgtgagtcgacgtacaggttaccggngtaccggtacggtgtttaggtattagttacgttcgtaacgttcggtcgggaccgttacggg

SEQ ID NO: 44363 - DNA, 749 bp, Homo sapiens
  misc_feature: GYAE6OF02I7H8O.44.55.E11.1.454.CMB.1.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagacagtatatacacgaccggtgctcgatttagcactcgcacgttgggtttgggggggaggaggagcccagcactgggattccgaggtgtttccattcggtgatcagcactgaacacagaggactcaccatggagttttggctgagctgggttctccttgttggacttttaaaaggtgtccagtgtgaggtgcggntgatggatctgggaggaggnttagtccagccgtggggggtcccagagactctccgtgtgccagcctgtggctcaccgtnagcagccaactanactgacgttgggtccgcaggctccagggaagggctgggagtcggggtctgagtcaagttttnacgttggtgattttcgactattactacggctaacggtaccgttccggtaggtaacgggggtacccctagttttacccgaaccgtaactccgtaccccgttaaaggggtaccctaaaacgtttcccgaaacgggtaaacgtaacgggttttaacttcgtttaaccgaaagttacgtaaacccgaaaccttggaacggaacggtcggtaaccggtacgaccgggtaccctacgtttaacttaaaccgtggttaccgacggtaacgacggtaaacggttccgggtaccggtcgttaccggggtaaggtttccgggtttaaacgttttttacgttttaccgggtttttaaccggttacggttttacccgggttagggggttcccccggtaaaaccgggggg

SEQ ID NO: 44364 - DNA, 852 bp, Homo sapiens
  misc_feature: GYAE6OF02IJ8UA.44.55.E11.1.454.CMB.1.raw
tcagacagtatatacacgaccggtgctcgatttagcactcgcacgttggggtttggggagcttcagctgtgggtagagaagacaggactcaggacgatctccagcatggccagcttccctctcctcctcaccctcctcactcactgtgcagggtcctgggcccagtctcgtgatgtctcagccaccctcagcgtcgtcggggacccccgggcgacgggggtcaccgacttctccgttgttccgtgggaacggacgttaccaaattacgtacggacttccgttaatcctaggtcaacgttcggtaactcgggggaccttccccgaggtccgaccgggtcccccccgtaacgttccccgttagtaccgttaacgtccgtaccttaaccgtaaacgtccggtaccggacccgggttccccgtacggtaaccggggttcccccgtacggtaccccgttagttccgttaccgtcgggtacccttaccggaaacgtttccggtcggtacctaccgtaaccggacggtccgtaacccgtcggtcccttaacgttccgtttacggaacttcccggtaccgtcgttaccggttagggtacgtaacggttacggacgggtacttacggtaacgtttaccgttaacgttccggttcgacgtacggtacgtacggttacgggagtttaaccgggaacggttccggggaaacggttccgggtaggggttacggtttaccgggggacggttaacgggtacccggtaaaggtttccgggtaacccggttacccggtacggggttaaccgacgggttacccggaccgggttacccgtacccggtccccccggttagggttaaccccgg

SEQ ID NO: 44365 - DNA, 171 bp, Homo sapiens
  misc_feature: GYAE6OF02F73L7.44.55.E11.1.454.CMB.1.raw
  modified_base (171)..(171): a, c, t, g, unknown or other
  misc_feature (171)..(171): n is a, c, g, or t
tcagacagtatatacacgaccggtgctcgatttagcactcgcacgttgggtttgggtgttcggcggagggaccaagctgaccgtcctgggtcagcccaaggctgccccctcggtcactctgttcccaccctcctctatatactgtctgagcgggctggcaaggcgcatagn

SEQ ID NO: 44366 - DNA, 657 bp, Homo sapiens
  misc_feature: GYAE6OF02IF177.44.55.E11.1.454.CMB.1.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (509)..(509): a, c, t, g, unknown or other
  misc_feature (509)..(509): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtggtttcctcgttagctcttttaagaggtgtccagtgtcaggtgcagctggtggagtcgtgggggagcgtggtccagccgtgggaggtccctgagactctcctgtgccagcgtctggattcaccttnagtacctagtggcatgcacgtgggtacccnccgagggcctccgaggacgaaggggctgggagtggggtcgactacgttatagtaggtatagagtaggaagttaaataaaagtacgtatacgactaagacctccggtggaacggtccgtattaccgacctaatccgtacaacgacgaactaacttaccgaaagaaccgacgtcgtacgttactctacgactaaacgtcgaaacncgtaccgtagacgtacggacccgaggaaccgtaccggacgttacggtacggttaactttaacccggtgggtaacggtaccggtaacgggtaacttaacggttaagtttaaccgggtttaaccggtacccttaacccggttaaccccgg

SEQ ID NO: 44367 - DNA, 760 bp, Homo sapiens
  misc_feature: GYAE6OF02GWSM0.44.55.E11.1.454.CMB.1.raw
  modified_base (609)..(609): a, c, t, g, unknown or other
  misc_feature (609)..(609): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtaacttttaaaaggtgtccagtgtgaggtgcggctgatggagtcgtgggaggaggcttagtccaggtccggtcgggggtcccagacgaccgttctcctgtgcagcctcgtgggcctcgccgtcgagcacgactaactacagttcggtaggttcgggtcccgccgacggtccgtaccggaagggggtaacggggtactggggacggttcggggttacctcgtacggttacgtaagtttttaacgtaccggttggtttacgttaactttttaccaaccgttaaacgtttaaccccgttaaaccggaccttaaaccgggtaacccgttacccggggttaagggaaaccgggggtacccttaacgtttacccaacctacgttacccgtaccggaacgggtaacctaacgttaccgaaacggtaaccttacggtttacttaccgttaanaaacgttacgaaacctaccgtagaacggtacgacgtaaccggactaccggtccgttaactacttacgtgtcgacgagacgtggtcgcgtcgttcgggaagtttcgtttaagttacgttggtttagccgtttacggcggtaccgtaaccggg

SEQ ID NO: 44368 - DNA, 751 bp, Homo sapiens
  misc_feature: GYAE6OF02JCUOV.44.55.E11.1.454.CMB.1.raw
  modified_base (262)..(262): a, c, t, g, unknown or other
  misc_feature (262)..(262): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggtagttttggctgagcgtgggttctccttggttggtaacttttaaaggtgtccagtgtggaggtgcggctgagtggagtcgtgggaggaggcttagtccagccgtgggggtcccagacgactctctgtncagcctcgtgggcctcaccgtcacgcacgcaactacatggtagttcgggtcccgcgacggtcctccggaggggaacggggtcgtagggtaggtcgggtacctcgaggtctaagttttacacggttggttagacttttaccactaacgtaaccttacgacacgtacgttacccggtaggtaaacgggggcctaattaccgaacccgtactcccgtaccggaacggggtaacttaaacgttacccgaacgggtaaaccgttacggttttaactaccgttaataaacgttcgaaaacctaaccgtaggaaggtacggaccgtacggaaccgtacgggtacccgtactttaacgttagtacggtacgacgaacgtacggtaacgggtccggacggttaccggttagggtaacgggtttacgttttaaggttttaccgttttacggttttaccggtaaccgttttccgggtacgggggcccgttaaaccggggg

SEQ ID NO: 44369 - DNA, 843 bp, Homo sapiens
  misc_feature: GYAE6OF02HPOHB.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctggtggagtcgtgggggaggcgtggtccagccgtgggaggtcccgtgagactctcctgtgcagcgtctggattcaccttcagtacctatggcatcgcacgtcgggtcccgccgacggcctccgaggacgaacggggcgtcgggaggttcgggtggactacgtttaagtagttacggttagtaggtagtaagggtaaagttaaagtaaaattaacgtatacgactacggtaaccttccggtagggaacgggtcccggtaactttacccgaaacccctgttaccccgttaccgaacgggtaacggtaaacccttaaacgtttaccccgaaaaaggtaaaccccgtaacggttaccgtttacggttaaactttccggtaacgtaaccgtaaaaacgttcggtaaaaccgtaccggtaaacccgttaaggggaaccggtaaccggtaacccccgggggaaacgggtaaacccggaaccgggttccgtttaacggggtttaaggttttaaacccgtttttaacggtggggtttaacccggaccgggtaaaacggggttaacccgttaaagttttaaacgggttttaccgggttaaaccccggtttaaaccgttaaccccccccgttaccgggttacccggttaacccgggg

SEQ ID NO: 44370 - DNA, 586 bp, Homo sapiens
  misc_feature: GYAE6OF02GGROZ.44.55.E11.1.454.CMB.1.raw
  modified_base (366)..(366): a, c, t, g, unknown or other
  misc_feature (366)..(366): n is a, c, g, or t
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgtgcgagggggtcaccatctcttgttctggaagatcaatatcggatcttatcctgtctaactggtatcggggactcccaggccaccggccccccatccgttatctatcgctactatcagccgcctcgacgggtcctgcccgtatctctcggctaccagtcnggactactacgcgtacctacctggaccctatccctagactccttactagtccgtagagtagtggagcttagattacctatgtagctagacgagtcgggatcggaacgacgggaccggtaacggcgttgggtacggttgggacgggtaagggtaaccgtaggttccggtaaccgtccgtacggtaccgaccgacccgtacggtccctccggtaccccccgg

SEQ ID NO: 44371 - DNA, 972 bp, Homo sapiens
  misc_feature: GYAE6OF02FNJTV.44.55.E11.1.454.CMB.1.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgggagtctggaggaggcttagtccagcctggtcgggtcccagagactctcctgtgcacgtcctctgggcctcgacccgtcacgcagaccaactacatggtacggttcggggtcccgccgaagggtcctaccggaaggggggaacggggtcgtcggggaaggttcggggtccttacggacggttacttaagtttttaactaacggtttggggttacttaacgtttttcccgaaacgttaacgttaacccgttaaccgggaccgtaaaacggttaaccccgtttacccggggttaaaggggtaaaacccgggggtaccccgttaaccgtttttaaccccgaaaccccttaacgtttacccccgtaaccccggggtaaaacgggggtaaaccccttaaaaccggtttacccccgggtaaaaacgggttaaaaccccgttttaaacccggggtttttttaaccttaacccgttttaaaacccggtaaaaacgttaacccggtaaaaaacccgtaaaacccggttttaaggggaaacccggggtaacggggttaacccccgggaaaaccggttaacccggaaacccccggggggtttacccttttaaccgggtttaaacgtttaccgttgggttaacccggaccggtaacggtaaccggttaacggggtacccgggaccgtttacccgggtacgggtttaacggttttaggtttttaaacgtttcggtttttaccgtttaccggtaaccgttttcgggggtaccgggtaaccccggg

SEQ ID NO: 44372 - DNA, 689 bp, Homo sapiens
  misc_feature: GYAE6OF02FSJWL.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggaggaggcttagtccagccgtggggggtcccagagactctcctgtgcagcctcgtgggctcaccgtcagcagcaactacatgaggttcgggtcccgccgaggccgtccggaaggggaacgggggctaggggaggtcggggtctcgagttctaatttacgtacgtggtagtacttttcactatactacgcacgtactccggtaggaacgggtcccgtattccgacctactcccgtaccgaaggggtaacctaacgttacccgaagggtaaaccgttacggtttacttaccttaacgaaacgttacgaaacctaaccgtggtaacggacggaccgtacggaccgaccgggtcccgtacgttaacgttaccgtggtacggacgtaacgacgacgggtccggtacgtccgtacgggtagtttacggtttaagtttacgtttcggtttacgtaccgtttcgggtcggggtaccgtaacccgggg

SEQ ID NO: 44373 - DNA, 851 bp, Homo sapiens
  misc_feature: GYAE6OF02J08Q7.44.55.E11.1.454.CMB.1.raw
tcagacagtatatacacgaccggtgctcgatttagcactcgcacgttgggtttgggggggagaggagcccagcactgggattcccgaggtgtttccattcggtgatcagcactgaacacagaggactcaccatggagttttggctgagcgtgggttctccgttgttggacttttaaaaggtgtccagtgtgaggtgcggctgtatggagtcgtggagggacggtcgtttagtcccgaggtcccggttcgggggggtccccaggaggtacctcgttccgtggtcgcaggtcccttcgtgggtctccacccgtcgacgtcgacgtaccaacttacaacgtggtaaggtttccggggtccccgccggtacggccttaccgggaacgggggtaacggggccgtaggggtaggttcgggtactaccgtagtccttagttaacttacggtggttgttacttcacgtaagtacgttaacgaccgagtaccgtccggtaacggaacggtcggtaacttccgaacctgtacccgtaccggtaaagggtaaccttaagttacccggaaagttaaccccggttaagttttacccgtactttaaccgaaaacgtcgtaaaccctaaccggttagaacgggtacccggaccggtaaacacccggtaacccgggtacgtttacccgttaacgtttaacgtcgggtaaccgaccggtaaacggtaccgttaaaccggggtcgggtacccgttaaccggggtttacgggtaccgtttttaaggggtttaacttttcgggttttaaccggtttttaaccgggttacggttttaccgggggttaccggggtaccccgttaacccggggg

SEQ ID NO: 44374 - DNA, 856 bp, Homo sapiens
  misc_feature: GYAE6OF02IE28K.44.55.E11.1.454.CMB.1.raw
  modified_base (284)..(284): a, c, t, g, unknown or other
  misc_feature (284)..(284): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtcggggggtcccaggagactcctcctgtgcacgcctcgtgggcctcgacccgtnagcagcaactacagtggtacggttcgggtcccgccgaggtccgtaccggaagggggtaacggggccgtggggacgggttggggtccttcgtacggttacttaattttacgtacgttggttagttactttcaacgtacttaccgtacgacgacgtacgttaccgtacgggaacgggtccgtactttaccgaaccgttacgtccgtacccgggaagggtaacctaaacgtttacccggaaacgggttaaacccgttacggtttttaacttacctttaaaccgaaaacttacggtaaaacccttaacggtagggtaacgggtaacgggtacccggaaacccggtaaccggtaaccccggggttacccgttttaaccgtttaaagttttacccgggtaggttaccgggtaaccgttaacggaacccggttaacggggtccccgggaaccggttccgggttaacggggttaagggtttttaccggggttttttaaattttccgggtttttaccgggttttaccggtttacccggtttccgggggttaccggggggacccccgttaaacccggggggg

SEQ ID NO: 44375 - DNA, 723 bp, Homo sapiens
  misc_feature: GYAE6OF02HTENW.44.55.E11.1.454.CMB.1.raw
  modified_base (215)..(215): a, c, t, g, unknown or other
  misc_feature (215)..(215): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggnggcttagtccagccgtgggggtcccagagactctcctgtgcagcctcgtgggcctcgaccgtcagcagaccaactacatgtaggttcgggtcccgccgacggtcctaccggaagggggacgggtcgtagggacggttcgggtctcgagttactaatttagtacgtggtgtactttcaactactactacgcgagtacgtccggtaggacgggtacctattaccactactccgtaccgaaggaacctacgttaccgaaggtaaacctacggttttacactttaacaaactacgaaacctaaccgtggaacggacggaccgaaccgtaccggacccggttacccgttacgttaacgttaccggtggtaccgggaacgtaacggtaaccgtaacggggtcccggtacggtaccggttacggggttaagtttacgggttttaacttttaacgggtttttccggtttaacgtaccgtttttaccggggtaccgggggaacccgtaacccggggg

SEQ ID NO: 44376 - DNA, 741 bp, Homo sapiens
  misc_feature: GYAE6OF02G9I7K.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtctggaggaggcttagtccagccgtcggggggtcccagagactctcctgtgcagcctcgtgggctccaccgtcagcagacaactacatgacggttcgggtccgccgacggcctccggaaggggaggggctagggacggttgggtctcgtagtctaatttacgtacgtggttgtacttttccactaacttaactacgaccgaacgtaccttccgggtagggaacgggccgtaacttacccgaacctaccgtaccttacccgaagggtaacctaacttaccgaacggtaaccgttacggtttactacttacaaacttacgaacctaaccgtagacgacgggtaccgaaccggaccgtacccgggtacgttaccttaacgtttaccgtcgtaacggtaccggtaacggtaaccggtaacggtaccggggtcgtacccggttaacgggtacgggttttacggttttaacgtttaacggtttttaccggttttacggttaccggttttccgggtacggggggtacccgtaacccggggg

SEQ ID NO: 44377 - DNA, 769 bp, Homo sapiens
  misc_feature: GYAE6OF02IS2OQ.44.55.E11.1.454.CMB.1.raw
tcagacagtatatacacgaccggtgctcgatttagcactcgcacgtttggggtttgggggggagaggagcccagcactgggattccgaggtgtttccattcggtgatcagcactgaacacagaggactcaccatggtagttttggctgagctgggttctccttgttggtaacttttaaaaggtgtccagtgtgaggtgcggctgagtggagtcgtgggaggaggtcttagtccaggccggtcggggggtacccaggacgactcctccgtgtgcacgcctcgtgggtcctcgaccgtcacgcacgacaactacagtggtaggttcggggtcccgccgacggccgtaccggaagggggaacggggcgtggggtaggttcggggttctacgtagttacttagttttaacgtacgttggttattatttacactaacttacgtaccgacgtaacgtacccgtaccggtaggaaaccgggtccgtaacgttccgaaccctacgtttcccgtaccggaacgggtaaacctaacgttacccgaaagggtaaaccgttacggttttactaccttaaacgaaagttaccgtaaaacctaaccgtggaacggagtaccggaacgtaaccggtacccggttcttacttacgtttaagtcggtacgaacgaaccgtacgtaacggtccgggacgttaccggtagggttaggtttacggttttacttttacggttttcggtttacggtaccgtttccggggtacgggaccccggtaaccgggg

SEQ ID NO: 44378 - DNA, 1009 bp, Homo sapiens
  misc_feature: GYAE6OF02G6SDO.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtctggaggaggcttagtccaggtccgtgggggtcccagacgactctcctgtgcacgtcctcgtcgggtcctaccgaccggtcacggccagaccaaactacagttggacggttcgggtcccgccgtacggccgtaccggaagggggaacggggcgtgggtaggtcgggtcgtcgagttacttaatttacgtacgtggttagtacttttacaaccgtaacttaaccgtacgtaccgtacgtacccggttacccgggttaacgggaaccggggtacccgttaacgtttaccccgaaacccgttccttacccggtaaaccccgggaacggggtaaaccttaaacccggtttaccccgggaaaaacgggggttaaacccttttaacccggggttttttaaacttaacccgttttaaacccgtaaaaaagttaccggtaaaaaccctaaaccgggttgggtaaaaccggggccgggttaaacccggaacccgggtaaccgtaaaccccgggggtttccccgtttaaacgttttaaccggtttttaaaccccgggttcgggttaacccggggtaacccggtaaacccgggttaaacccgggtaaccggggttttacccccgggggtaccccgggtttaaccgggggttttacgggggttaaaccgggttttttacgggttttttttaaaaccggttttttacccgggggtttttttaacccgggttttttaacccggtttaaccccgggttttttacccgggggggttaccccgggggggtaaccccccggttaaaaccccggggggggg

SEQ ID NO: 44379 - DNA, 775 bp, Homo sapiens
  misc_feature: GYAE6OF02JKPC7.44.55.E11.1.454.CMB.1.raw
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagacagtatatacacgaccggtgctcgatttagcactcgcacgttgggtttggggggggaggaggagcccagcactgggattccgaggtgtttccattcggtgatcagcactgaacacagaggactcaccatggattttggctgagctgggttctccttgttggacttttaaaggntcagtgtgaggtgcggctgatggagtctgggaggaggcttagtccgagccggtgggggtcccagngactctcctgtgcngcctgtaggctcgaccgtcagcagaccaactaccagtcggtaggtttaccgggtacccgaccgtaggacctaccggaagggggtaaagggggccttagggggacggttcggggtcctacgaacggttcgttaacgtttagtaaccgttgggttagtaactttttcgaaccgtaataccgtaacgccgtacgtaccgttacccggtagggaaaccgggtccctaagttcccaaccgacgttacccgtacgaaccgggtactaacgttccggaaacggtacgtacgttacttcgttaactaaagtaccgtaaactacgtaggtacggaaggttacccgggacaaaccggacccggggttccttaacggtttaccctttacggtaccgttacgggaaccggtacctaggtaaccggggttccgacggttccgtcgggttaaacggttacggttttaacgttaccgttttacgggttacccgtttacgggtttaccgtaccggggtaccggtaaacccgggg

SEQ ID NO: 44380 - DNA, 970 bp, Homo sapiens
  misc_feature: GYAE6OF02JLDZY.44.55.E11.1.454.CMB.1.raw
  modified_base (179)..(179): a, c, t, g, unknown or other
  misc_feature (179)..(179): n is a, c, g, or t
  modified_base (280)..(280): a, c, t, g, unknown or other
  misc_feature (280)..(280): n is a, c, g, or t
tcagacagtatatacacgaccggtgctcgatttagcactcgcacgttggggtttgggggggagaggagcccagcactgggattccgaggtgtttccattcggtgatcagcactgaacacagaggactcaccatggtagttttggctgagctggttctcttgttggtacttttaaaggtntccagtgtgaggtgcggctgagtggagtcgtagggaggacggtcttacgtccgaggtcccggtcggggggtcccaaggacgtacctcctccgtggtgaccncgtccctcggtcgggtcctacccgaccggtcgacggacctacgacctaaacgtacgtagtggtacgggtttccgggaccccgccggacggtcctaccgggaagggggacggggtcgtagggcggttcggtctacgtagttacttaattttacgtacggttggtattactttacaacttacgtttaccgtacgtaccgtaacgtacccgttacgggtacggaacgggtacccgtttaactaccctaaaccgtactttaccccggaaccggtaacgggtaaacccttaaaccggtttaacccgggaaacgggtttaaaaccggtttacggtttttaaaccttacccggtttaaaactaaaaacgttaacccggtaaaaacccttaccggaaaggggtaaaccgggaaccgggcccggtaaacccgtaaccggggttaacccccgggttaccttttacccgtttaaaacgggttttcggccccgggttaaaggtaaacccggggtaaacgtacccgggtttaaacgggccccggggtttaaccccgggtaaacgggttttcgggggtttaaaagggtttttacccgggttttttaaggtttttaaccgggtttttttcccggtttaaacggggtttccccgggttttacggggggttaacccccgggggtaacccccgggtttaaacccgggg

SEQ ID NO: 44381 - DNA, 773 bp, Homo sapiens
  misc_feature: GYAE6OF02HAQ0W.44.55.E11.1.454.CMB.1.raw
tcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgagtggagtcgtgggaggaggcgttagtccaggccgtgggggggtcccaggagctcctcctgtgcgagcctcgtgggcctccaccgtcagcagacaactacagtgaggttcgggcccgccgaggcctccggaggggacggggcgtgggaggtcgggtctcgtagtctaagtttactacgttggtagtatttcgactacgtactaacggcaacggtaccgttaccggtagggaaaccgggcccgtaacgtttccaacccgtagttccctacccggaagggtaacctaaacgttcccgaagggtaaaccgttacggttttactccgtttaacgaaaattcggaaaaccctacccggttagaaacggggtcggaaccggtaaacccggaaccggaccccggggttaccgttaactttaacgtttacggagtaccgggaacggaaccgaacggttaaccggtcccgggggcctacccgggttagggggaaggttttttcgggttttaaacgtttacgtttttcgggttttaccgttaccgggttttccggtacggggggtaccccttaacccgggggg

SEQ ID NO: 44382 - DNA, 816 bp, Homo sapiens
  misc_feature: GYAE6OF02IZR7H.44.55.E11.1.454.CMB.1.raw
tcagacagtatatacacgaccggtgctcgatttagcactcgcacgttggggtttgggggggaggaggagcccagcactgggattccgaggtgtttccattcggtgatcagcactgaacacagaggactcaccatggagttttggctgagctgggttctccttgttggactttaaaaggtgtccagtgtgaggtgcggctgagtggagtctgggaggaggcttagtccaggccgttggggggtccccagtacggacgtctcccgtggtgccagcctcgtgggacctccaccgtctagcagtccaactacatcgtaggttcgggtacccggcgacggtccgtccgaagggggtaccggggacgtgggtaagggttcggggtccttcgtacggttacctagtttttaacgaccggttaggggttcgaacgttttttaccggaactacgtttaacctaacggtacccgaagggtaccgtttaccccggtaggaaacgggggggtaccctacggtttacctaacccgtaacgttacccgttaccgtaaacgggggtaaccctaaaccgggtttaccccgaagggttaaaccgtttaaacccgggttttacttaacccgtttaactaaactttaacggaacctaaccgtaggaacggacggtaccggaccgtaacggtaccgtaccggtaccttacgttaaccttggtacgggacaacggtacgtacggtccggtccggtaccgtagggtacgtttaggtttacgttttaacggtttcgttttacggtacccgtttacggtacgggggtccgtaacccgggg

SEQ ID NO: 44383 - DNA, 731 bp, Homo sapiens
  misc_feature: GYAE6OF02F4ZC4.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttgtacttttaaaaggtgtccagtgtgaggtgcggctgatggagtctgggaggaggcttagtccagccgtggggggtcccaggagactctcctgtgcagcctcgtgggcctcgacccgtcagcagcaactacatgagttgggtcccgcaggcctcgaggggaaggggcgtgggaggtcgggtctcgagtctagtttactacgtggtagtatttccaactattaaccgtaccggacaaggtaccttcccggtaggaaacgggtcccgtaattccaaccactccctacccgaagggtaacctaaaccgttacccgaaacggtaaaccgttaacggttttaacttaccgttaactaaaacttaacgaaaaccctaaaccgtaggaacggacgggtaaccggaaacggaccgtaaccgggtacccgttaaccgttaagtttaaccgtacggtaggtaccggaacgtaacgtaacgggtaccgggaccgtcggttaccgggtaggttacgtttaagttttacggtttccggtttacggttaccgtttccgggtacggggtacccgtaaccggggg

SEQ ID NO: 44384 - DNA, 672 bp, Homo sapiens
  misc_feature: GYAE6OF02I02LC.44.55.E11.1.454.CMB.1.raw
  modified_base (306)..(306): a, c, t, g, unknown or other
  misc_feature (306)..(306): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcacgcctcgtcgggcctcaccgtcacgcagcaactacatgagttggtccgcnggctaccggaggggaacgggctggagtgggtctcgagtctatttatacgtggtagtatttacactatactacgcaacgtactccggtaggaacgggtcctaattaccgaacctacgttaccgtaccgaaacggggtaactaaacgttccgaacggtaaactaccggttttaattaccttaactaaacgtacgaaaacctaaccgtaggaacgggaacggaccgaaaccggacctaacgggtccgttaacttaagtttaccgtggtagacgaagaaccgaggtccggcggtacgtacgggtaacgtttaggtttaactttacggtttacgtttcggtaccgtttacgggtcgggaccgtaaccgggg

SEQ ID NO: 44385 - DNA, 609 bp, Homo sapiens
  misc_feature: GYAE6OF02HPODI.44.55.E11.1.454.CMB.1.raw
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctcgtgggctccgaccgtcagcagcaactacatgaggttcgggtccgccgaggcctccggaggggaagggcgtggnggtgggtctcagtctatttatacgttggtntatttcactatactacgcagacctcgtaggacggccgtatccacctactcctaccgacggaactaacgttaccggaaactacttaacttttcgtagtaaactagaacacgtacgtagacgagtacgaaagaccgaccgtacctttatttctggtcgaggtaagggacgggggacgtggacgtaccgacggtaggtcggggtgggttcggtacgtaccgtcggtcggggacgagggtcgtcccgg

SEQ ID NO: 44386 - DNA, 697 bp, Homo sapiens
  misc_feature: GYAE6OF02HKQOO.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctgggaggaggcttagtccagccgtgggggtcccagagactctcctgtgcagcctcgtgggcctcaccgtcagcagcaactacagtggtagttcgggtcccgccgaggtcctaccggaggggaacggggccgtgggacggttcgggtctcgtacgtactaattttagacgttggtacgtattttacgaactaactacctacgctaacgtaccgtccgtaggaacgaccgtacttccgacctactccgtaccgagggtaacctaacgttaccggaacggtaaccgttaccggtttaacttccttaaacgtaaactacgtaaaccaacgttaggaagaccggacgaaccgacgaccggtccttacttaacgttctaggtcgacggaagaccgaagggttccggtcgtacgttaccgggttaagttacgggttttaactttacggtttccggtttaggtaccgttttacggccggggtacccgttaaacccggg

SEQ ID NO: 44387 - DNA, 576 bp, Homo sapiens
  misc_feature: GYAE6OF02F5HR4.44.55.E11.1.454.CMB.1.raw
  modified_base (375)..(375): a, c, t, g, unknown or other
  misc_feature (375)..(375): n is a, c, g, or t
  modified_base (470)..(470): a, c, t, g, unknown or other
  misc_feature (470)..(470): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttgggtccgccgaggctccgaggggaaggggctgggagtgggtctcgagtctatttatacttggtgatttcactatactacgnacgactcgtagaacggccgattccacctatcctccaagggacaacgttccaaggtaacctacggtttactcttacaaatacgaacaaccgtgagnggaccgaacgacgacggtcctactaattactgtcgacgagacgaagtcggcgacgttcggagttgttaattcgtttcgtttagacgtttcggtcgggacctacggg

SEQ ID NO: 44388 - DNA, 731 bp, Homo sapiens
  misc_feature: GYAE6OF02IAADI.44.55.E11.1.454.CMB.1.raw
  modified_base (215)..(215): a, c, t, g, unknown or other
  misc_feature (215)..(215): n is a, c, g, or t
tcagacagtatatacacgaccggtgctcgatttagcactcgcacgttgggttttggggagcttcagctgtgggtagagaagacaggactcaggacgatctccagcatggccagcttccctctcctcctcaccctcctcactcactgtgcaggtcctcgggcccagtctgttgatgtctcacgcccaccctcacgccgtcgtcgggacccccgggngacggggtcacgtactcttcgttgtcgtaggaacgtaacgtacaattacgtcgattccttatcctcgtacaacgttggtacggtacgggacctcccgaggtacccgaccggtcccccgtacttcccttattcctacgtcgtacttactaactccgacggtcccgtaccgtaccggtacgggtcccctacggtaccgtacgttacctccgtacgtccgtaccgtacgtacgtacggaccgtactaacgacggtccttaccgtacggtacccttacgttccgttagtaccttaccgtaccgtacgttacgtacggtaacgtaacgtcgacggttacgtacgttaacgtttacgacgttgtacgacgtacgacgtaggtcggtaagtacgaacggaccgaaccgggtacgggtacgttcggggttacggttaccgggacggtacggtaccggtaaggtttccggaccgttaccgtacggtacgtaccgaccggtacgtcccgtcccggcccgtacccgg

SEQ ID NO: 44389 - DNA, 720 bp, Homo sapiens
  misc_feature: GYAE6OF02I1S99.44.55.E11.1.454.CMB.1.raw
  modified_base (223)..(223): a, c, t, g, unknown or other
  misc_feature (223)..(223): n is a, c, g, or t
tcagacagtatatacacgaccggtgctcgatttagcactcgcacgttggggtttgggggggagaggagcccagcactgggattccgaggtgtttccattcggtgatcagcactgaacacagaggactcacatggtagttttggctgagcgttggttctccttgttaggtaacgttttaaaggtcgtccagtgtgaggtgcggctgagtggagtcgtgggaggnggtcttagccaggtccggtcgggggtcccagacgctcctctgtgacacgtcctcgtcggtcctcaccgtcagccagacctaactacgagtaggtacggttccggccgccgtagccgtaccggaaggggacgggtcgtgggtacggttcggtaccgtacgtagttaacgttagttttactacggttggtagttactttacaacgttaagtaaccgtacgtacgtaacgtacccgtacggtaagggaccgggtaccttacgttaccaaccgttacgtccgaacggaaacggtaactaaactccgtaaaggaacctttacgttatactaactaaatacgtaaacacgtagaacggaacgtaccgacgtaaccgtaccgtcgttaacttagtacgtcgacgacgactaccggtaggtaccgcgttaacggcggtttaacggttagtttaacgtttacgtttcgttacgtaccggtttcgggtaccggaccgttaaccgggg

SEQ ID NO: 44390 - DNA, 604 bp, Homo sapiens
  misc_feature: GYAE6OF02I22XY.44.55.E11.1.454.CMB.1.raw
  modified_base (214)..(214): a, c, t, g, unknown or other
  misc_feature (214)..(214): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (461)..(461): a, c, t, g, unknown or other
  misc_feature (461)..(461): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggnggcttagtccagccgtgggggtcccagagactctcctgtgcagcctctgggctcaccgtcagcagccaactacatgaggttcggtccgcaggctccgaggggacgggctggagtgggtctcgagtctatttactacgtggtagtatttccaactntaactacgnaacgtctccgtaggaacgggcctattcaccatccgtcgaagggacaacgttcccaaggtaaccgtaggttttacaccgttaanaaacgttcgaaaaccctaccgtaggaacggtacggaccgtaacgacaccgggtccttataacgtttcngtgaccganacgtagacgggctcgtaggagtttgtaatttcgtacgtttgacgttcggtacgggacctaacgggg

SEQ ID NO: 44391 - DNA, 787 bp, Homo sapiens
  misc_feature: GYAE6OF02FGVTE.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagtttggctgagctgggttctcctgttggacttttaaaaggtgtccagtgtgaggtgcggctgagtggagtctgggaggaggtcttagtccgacggtccggtcggggggtcccaggacgtacctcgtccgtggtgccgacgtcctcgtcgggctccaccgtcgagcagctaacgtacagtggtagtcggggtcccgccgtaggcctaccggaagggaacgggtctaggggaggtcgggtctacgagttccttaagtttacgtacgtggttagtacgttttaccgactaacgtaaccgtacgaccgtaacgtaccgttaccggtaggaacggggtacctaacgttacccaacgtactaccgtaacccggtaagggtaacccttaacgtaccgtaaacggtaaccgttaaccgtttactaccgttaaacaaacgttaacgaaaccgtaaccgttaggaacggtaacggtaccggtaaacggtaaccggtacccggtaccgttagttaaaccgttcgtacggtacggtaaccggacgtaacggtacggtacccgggaccgtccggtacgggttaacggtttacggtttacgttttacggtttaccggttttaacggtaccgggtttccgggtaccggggtaaccgttaacccgggg

SEQ ID NO: 44392 - DNA, 627 bp, Homo sapiens
  misc_feature: GYAE6OF02FTI6B.44.55.E11.1.454.CMB.1.raw
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (497)..(497): a, c, t, g, unknown or other
  misc_feature (497)..(497): n is a, c, g, or t
  modified_base (513)..(513): a, c, t, g, unknown or other
  misc_feature (513)..(513): n is a, c, g, or t
  modified_base (555)..(555): a, c, t, g, unknown or other
  misc_feature (555)..(555): n is a, c, g, or t
tcagacagtatatacacgaccggtgctcgatttagcactcgcacgttggggtttgggggggagaggagcccagcactgggattccgaggtgtttccattcggtgatcagcactgaacacagagactcaccatggagttttggctgagcggtcgttgctaggtcgacttaaagtgcngtgngngtncgntgatgatntggagacgcttagtcacgcgtcgggggaccagacgacttctccgtgtgccncgtcctcgttacgggccaccgtaccgtcgacgtccgacgtccgaaacctctagtcggtacggttcgggtccaccgacggtccaacggagggaacgggctaggnggttcggtctacnggtttactatttacgacgttggttcttactttaccaactaacgtttaccgtacgcaacgggtaccttaccgagggaacggcctactcaacgctctaccggaggtacatccgaagacgtcgttactccgttaaanaagtactaacacgtanacggacgaaccgtacgacgtaccgtactactaagtcgttggnacgtagacgtacggcgtaccgtgtacgtgttaacgttattcggttattacgtaggtcggtcgacggtaaccg

SEQ ID NO: 44393 - DNA, 614 bp, Homo sapiens
  misc_feature: GYAE6OF02GUNBW.44.55.E11.1.454.CMB.1.raw
  modified_base (497)..(497): a, c, t, g, unknown or other
  misc_feature (497)..(497): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgagtggagtctgggaggaggtcttagtccagccgtgggggtcccagagactctctgtgcacgcctcgtgggcctccgaccgtcgagcagactaacgtacagtggtacggttcggtacccaaccgtacggacctaccggaaggggtaagggccgtaggggaggttcgggtcctacgagttactaagttttatacgttggtatacgtttacactaagttacctacgactacgtaccgtcgtaaggaccggcctatccactactacctacgaggaacctacgtaccgaggtaacctacggttntacttaacgaatacgaactacgagaggacgaccgacgacgacgtcctactaattcgtgacgagacgagagtcggctagtcgtagtagttatcgttgtcgtcgttggcggacgtacgg

SEQ ID NO: 44394 - DNA, 786 bp, Homo sapiens
  misc_feature: GYAE6OF02INU78.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagccgtggggggtcccagagactctccgtgtcgcacgccttcgtcgggcctccaccgtcacgcacgacaacgtacatggtacggttcgggtcccgccgacggccgtacccggaagggggaacggggcgtggggtaggtcgggtcctcgtacggttactatttacgtacgtggttgttatttcactagttactacgctaagaccgtccgtaggacgggtaccgtattcccgacgtatacccgtcgaagggtacctaacgttcccggaaaggtaaccgttacggttttacttaccgttactaaaacgtacgtaaacccgaacgttacgggaagtaccggggaacccgaaacccggtaacgtaccggggtaccccgttaagttaaccttttaacgtcggtaacgtaccggtaacgtaccgtaaaaccggggttcccgggccgttaccgggttccgggtaaacggttttacgggtttttaaccgtttttaccggttttacgggttttaaccgtttaccggtttaaccccgggtttcgggggggtaacccccgtttaaacccgggggg

SEQ ID NO: 44395 - DNA, 832 bp, Homo sapiens
  misc_feature: GYAE6OF02I84EE.44.55.E11.1.454.CMB.1.raw
  modified_base (171)..(171): a, c, t, g, unknown or other
  misc_feature (171)..(171): n is a, c, g, or t
tcagacagtatatacacgaccggtgctcgatttagcactcgcacgttgggtttggggagcttcagctgtgggtagagaagacaggactcaggacgatctccagcatggccagcttcctctcctcctcaccctcctcactcactgtgcatcggtccgtcgggccagtctgtnatgtcctcacgccacctcacgccgtcgtaccggggaccccgggacggtacgggggtaccaccgtacttccttcgtttcggttacggtaaggggtaaacggtaacgtaccgtaaagttaacgtcggtaactttacgtttacttaccgttaacgtaaccgttaacgttaacgggtaccggttaccgggggtaacccttacccggaacggtaaccccggaacccccgggtacccccttaaccgttaaccgtttacttaccgttaactacgtaacttaaaccttaacgtaccgaccggtacccggtacccgttacgggtaacccggggttcccgtaccggtaccgtactttaccgtcgtacggtacctaacggtacgtcggtacgtactaacgtacgaccgtacgtaccgtgaccctattacccgttagtacccttcgtaaccgtcggtactacgggtagtacgtaccggtaaggttacttacgttaacttaaccggtactcggtaacggacgtactaggttacggaggtaaacctcggaaccggaacgggtaccggtagggtacgtcggggtaggttacccgggaggtaacgggtactaacggttaaccgtaccggtacggtacgtaacggacccggtaccgtacgggtccctacccggtcccg

SEQ ID NO: 44396 - DNA, 688 bp, Homo sapiens
  misc_feature: GYAE6OF02IJ1CT.44.55.E11.1.454.CMB.1.raw
  modified_base (147)..(147): a, c, t, g, unknown or other
  misc_feature (147)..(147): n is a, c, g, or t
  modified_base (378)..(378): a, c, t, g, unknown or other
  misc_feature (378)..(378): n is a, c, g, or t
  modified_base (528)..(528): a, c, t, g, unknown or other
  misc_feature (528)..(528): n is a, c, g, or t
tcagacagtatatacacgaccggtgctcgatttagcactcgcacgttgggtttggggagcgttcagctgtgggtagagaagacaggactcaggacgatctccagcatggccagcttccctctcctcctcaccctctcactcactgtncagggtcctcgggcccagtctgtgatgtctcagccaccctcacgtcgtccgtcgggacccccgggcgagggggtccaccgtatcctacgttgtcgtaggaaggtaacgtaccaatagtcggtatactttaatcctgtacaacttggtacgtcgggacctccgaggtaccacccggcccccgtaactccttatctagtcgctaactaatcacgccgccctcgaccgggtccncgtccacttctcgtcgtccgtacctaacgtcgtcgcctacgtaacgacgtaccgtaccctcgggtccctaacgttccgtgaccttacgtcctacgtcgtacggaagtcggacgtacgggtcttacgtaactttaacgtacgtgtacgtanacgtctaagggtggagttaggaacgccggaccgggtaacgtcgggttacgggttcgggtaccgggaccggggtaacgggtaacgaaccggtttcggaacccgtaacggtcgggtacctaccggaaccgtacgggcccttcccggtaccccggtacccggg

SEQ ID NO: 44397 - DNA, 795 bp, Homo sapiens
  misc_feature: GYAE6OF02GA6G3.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagtttggctgagctgggttctccttgttggacttttaaaaggtgtccagtgtgaggtgcggctgatcggagtcgtggaggaggcttagtccaggccgtgggggtcccagacgactctccgtgtcgcagtcctgtcgggctaccaccgtcagccgtagacaaacgttacagttcggaggtttcgggacccgaccggaggtcctaccggaaggggaacgggtcgtagggtcggttggtctacgacgttctaatttacgtctcggttgtactttcactagttacaaccgtcacgaccgttaccggtaggaaaccggggtcctaacgtccgtaaacctacgtacccttacggaaacgggttaaccttaaacgttacccggtaaacgggtaaaccgtttaccggggttttaaccttacgttaaaacgtaaacgtacgtaaaacccgtaacgttcggaaagggttacccggggaactaacccggtaaccgggtaacccgccggtttaaacttaaccggtttaacctacgggttacgaaccgggttaacgaacccgggtaacggtacccgggtcggtaacccgggttagggtacgttttaacggttacgttttaacgttcggtttaacgtacgtttacccggggttgggaacccctttaacccggggg

SEQ ID NO: 44398 - DNA, 738 bp, Homo sapiens
  misc_feature: GYAE6OF02JY96Q.44.55.E11.1.454.CMB.1.raw
tcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtcagcagacaactacatgacggttcgggtcccgaccgacggccgtaccgaggggtaacggggccgtaggggtacggtcggggtcctcgtaggttactaagtttattaaccgtggtacgtaacgtttacacgtactaccgtacgtacagtacgtccgtaggaacggccgtaacttacccgaacgtactcccgtaccgaagggtaacctaacgttccgaaacgggtaacttaccgggttttaaacttccgttaaccgaaaagttcgaaacctaacccgtaggacgtaacgggaccgaaccgtacccgtaaccgggccgtttaaccgtaagtttaacccgtggtaacgtacgaacgaccgtaaggttcccgggaacgttacccggtacgggtagtttaacgggtttaagtttacgttttacgggtttaccgttaccgtttaccgggtaccggggtaacccgtaaccgggg

SEQ ID NO: 44399 - DNA, 788 bp, Homo sapiens
  misc_feature: GYAE6OF02IZYID.44.55.E11.1.454.CMB.1.raw
tcagacagtatatacacgaccggtgctcgatttagcactcgcacgttgggttgggggagaggagcccagcactgggattccgaggtgttccattcggtgatcagcactgaacacagaggactcaccatggtagttttggctgagtcgtcgggttctccgttgttacggtacttttaaaggtcgtccgagttgtgaggtgcggctggagtcggagtcgtggaggtacgtacgttacgtccgaggtccgtacgggggtacccagtacgtacctccgttcgttcggtcgacctagtccccgtcggtcgggtaccgttaccgtaccgtaccgtagacccgtagtacccgaacgttacgagtggtacgggttaccggggttccgacccggtaacgggtcccgtaaccggggtacgggggtaacggggtacccggttaggggtaccggtttacggggtaccttaaccgggttagtacgtttaacgtttacgttaacggttgggttacctaacgtttacaacctttacgtacgtaccgacgtagtaccgtcggtacgaacgggtcctagtcctaccgacgttaccgacgtaacggtactacgtacgtacgtaaccttcgtttactaccgtactaacgtactaaccgtacgtacgtacggagccgtaacgaccgtacgtacgtacgttacgttagcgtaccgtagaccgtaggtaccgcgtacgttaggtacgttaggttagtttacgttacggtttccgttaggttaaccggttcggtcggtaccggtaacccgg

SEQ ID NO: 44400 - DNA, 729 bp, Homo sapiens
  misc_feature: GYAE6OF02I877F.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgtggacttttaaaaggtgtccagtgtgaggtgcggctgatggagtctggaggaggcttagtccagccgtggggggtcccagagacctctccgtgtgcgagcctcgtgggacctcgaccgtcacgcagaccaactacatggagttcgggtccgccgaggcctaccggagggggaacgggcgtagggacggtagggtcctacgtaggttcctaagttttaactacgttgggtagtattttccgaactacttaactacggccaggtaccccttcgggaggtaaaccgggggtcccgtaactttaccgacccgttaacgtcccgttaccgaacggggtaactaaacgtttacccaagggtaaacccttacggtttacttaccgtttaacaaacgttacgaaacctaccgtaagaccgggtacggaccgaaccgaccggaccggtcccgttactaacgtttacgtcgtcgacgacggacgtacggtccggtccggtccggtacgggtaggtttcgggtttaatttacgtttggtttaccgtcggtttacggtcgggggtacccgtaacccgggg

SEQ ID NO: 44401 - DNA, 921 bp, Homo sapiens
  misc_feature: GYAE6OF02FYGEB.44.55.E11.1.454.CMB.1.raw
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtcagtgtgaggtgcggctgatggagtcgtggaggagcttagtccaggccgtgggggtcccagacgacctctcctgtcgcagcctcgtggctcacccgtcagcagccaactcgagtagtagttcgggtcccgccgacggtcgtccggaggggaacggggcgtagggacggttgggtcctacgacgttagtaacttttagtaccgttggttacgtaagttttaccgacgaactttaaccggtaccgacgtaacggtacccgtttaccgggtaagggtaaccggggcccgttaattaccccgacccgtaaccttacccggtcccgtaaacggggaaccttaaaccgtttaacccggaacgggttaaacccgttaacggggtttttaacctttacccgtttaaaccgtaaaacgttaacgtaaaaccccgttaaacccgtttcggggaaacggtaccgggaccgggtaaaccggtaacccgggtaacccggttaacccggtttaccgttttaaaacgttttaccgggtacggtttaaccgggaccggtaaacgggttaacccgggttaaaacggggtcccccgggggtaaccgggttaaccccgggttttaccggggggtaaacggtttttacggggtttttaaaccgtttttttaaccggttttaccgggggttttttaccgttaacccgggttttttccccgggggttacggggggttacccccggttaaaacccccgggggggg

SEQ ID NO: 44402 - DNA, 722 bp, Homo sapiens
  misc_feature: GYAE6OF02FSY48.44.55.E11.1.454.CMB.1.raw
  modified_base (186)..(186): a, c, t, g, unknown or other
  misc_feature (186)..(186): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
tcagacagtatatacacgaccggtgctcgatttagcactcgcacgttgggtttgggggggagaggagcccagcactgggattccgaggtgtttccattcggtgatcagcactgaacacagagactcaccatggagttttggctgagctgggttctccttgtgtacttttaaaggtgtccagtgtgnggtgcggctgagtggagtctggaggagtcttagtccaggccgtgggggcccagagacctcgtcctgtgcagtcctcgtggcctccnccgtnacgcacgtaccaactacagtcgtaggttcgggtcccgacgaggccgtaccggaggggaacgggctaggggacgttcgggtacctccgtacggttcttaacggttttatacgttggtagtacgtttacaccgttagtaacctacgctaagtacccgtcgtaggtaaccggcctactcgtacctatccgtaccgacggtactaacttccgaaagtaccgttacgttaactcttaaacgaagttcgaaacctacgtagacgacgtaccgaacggtaccgaccgggttccttaccgttaagttacgtacggtacggtaccgtaacggacgtaaccgggtccggtacccggttaccggttacggtaacggttttcggtttaaacgttttcggttttaccggtttaccggttaaccggttcggttttaccggggaccccgttaaccggggg

SEQ ID NO: 44403 - DNA, 669 bp, Homo sapiens
  misc_feature: GYAE6OF02FOOP7.44.55.E11.1.454.CMB.1.raw
  modified_base (167)..(167): a, c, t, g, unknown or other
  misc_feature (167)..(167): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (488)..(488): a, c, t, g, unknown or other
  misc_feature (488)..(488): n is a, c, g, or t
tcagacagtatatacacgaccggtgctcgatttagcactcgcacgttgggttggggggagagagcccagcactgggactccgaggtgtttccattcggtgatcagcactgaacacagaggactcaccatcgagtttgctgagctgggtctctgttgactttaaagtntcagtgtgaggtgcggtctgatggagtcgtggaggaggtcttagtccagcggtcgggggtcccagagtacctcttccgtgtacgcgacgtcctcggtggtcctaccgtaccgtnaccggtaccgacgtaaccaactagaacgttgtacggttcggacccgtaccgacggtccgtccgggaaggggtacggacgngggttaggcggttcncggtactcgtacttagtgtcgtatcttaccatactacgcactacgcgtccgacggtacggctacgtcacttcgactccgaggtactacgtccgaacggtactaggttacttntaagtaacgagacgtacgtagacgagtccgacggacctcggtaccgtccttacgtacttccgtggaaccgtagtaccgtacggttcggaacccgtggttaaccccgggtaggttttaacgttacgtttacccggtttggttaacccgttcgttccgggtacccggtaccggtaacccgggg

SEQ ID NO: 44404 - DNA, 886 bp, Homo sapiens
  misc_feature: GYAE6OF02HNVHG.44.55.E11.1.454.CMB.1.raw
tcagacagtatatacacgaccggtgctcgatttagcactcgcacgttgggtttggggggagaggagcccagcactgggattccgaggtgtttccattcggtgatcagcactagaacacagagactcaccatggtagtttggctgagcgtggttcttccttgttggtaacgttttaaaaggtagtccgtagtgtggtaggtggcggtcgtgtagtggtagtcgtgggagggaggtacgttacgtaccgacgtccggtccgggggtacccgagtaacaccggggggggggggggttcctccgtcgtcgcgacgtccgtccgtcggtccgtcctacccggtctacgacgacgaccaaacctaactaagtaggtacggttcgggtcccgacccgaccggtaccgtacccggaacggggtaacggggtacggtacgggtagggttcgggttccgttaccgtaacgttaccgttaacgtttaacgttacgttaggttacgttaacgtttacgtaacctaacttaaccgtaacgaccgtacgtaaccgtaccggtacggtaacgggtaccgtacttaccgaaccttactcccgtaaccggaaacggtaaccctaaacgttacccgaaaacgggtaaccgttaacggtttaaccttaccgttaaaccgtaaaacgtacggtaaaaccctaacggtaagtaaacgggaccgggaacccgtaaacgtacccggaccgggtaccctttaacgttaacgttaccggtgtaaccggtaccgaacgtaccggtaaacggttcccggacggttacccggtagggttaacgtttaggtttaacgtttacgtttacgggtttacgtaaccggttttccgggtacggacccgtttaacccgggg

SEQ ID NO: 44405 - DNA, 589 bp, Homo sapiens
  misc_feature: GYAE6OF02H1X0Y.44.55.E11.1.454.CMB.1.raw
tcagacagtatatacacgaccggtgctcgatttagcactcgcacgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggaccccgggcgagggggtcaccatctcttgttctggaagaagtcaatatcggatcttatcctgtcaactggtagtcggggactcccaggccaccggcccccgactccttatctatgctaactaatcgagccgccctcgacggggtcccctcgcccgtacttcgtccgtggtctacctaagtcctcggaccactacgaggtcctaccgtcggcctacttccttagtactcctcacgtcgtagagtagtgagcttagtacttactactgtgactagacagtgggatacgacgacggaccgggaacggtcggtagggttcggttcgggacgggtacggaccgtaaggtcgaccgtaccgtcgacgcgacccgaaggtcctccggcccctaccgg

SEQ ID NO: 44406 - DNA, 812 bp, Homo sapiens
  misc_feature: GYAE6OF02JT1R9.44.55.E11.1.454.CMB.1.raw
  modified_base (214)..(214): a, c, t, g, unknown or other
  misc_feature (214)..(214): n is a, c, g, or t
  modified_base (646)..(646): a, c, t, g, unknown or other
  misc_feature (646)..(646): n is a, c, g, or t
  modified_base (714)..(714): a, c, t, g, unknown or other
  misc_feature (714)..(714): n is a, c, g, or t
  modified_base (723)..(723): a, c, t, g, unknown or other
  misc_feature (723)..(723): n is a, c, g, or t
tcagacagtatatacacgaccggtgctcgatttagcactcgcacgttgggtttggggggagaggagcccagcactggattccgaggtgttccattcggtgatcagcactgaacacagaggactcaccatggagttttggctgagtcgtgggttcctccgtttgttacggtaacgtttttaaaagggtgtacctagttgtaggaggtcggtcggnttagagtgggtagttacgtagggaagggtaggtacgttacggtaccgtcggccgggtaccgggggtaccgacggtaacgtaccgttccgtacgtcgtcggacgtcgtaccgttacggtcggtacctacccgaccgttacgacgacgtaccgaactaacctagtacggtacggttacggttcccgggccgacccggtaggtacccggtaccgggaaaggggtcgggtacgtagggtacggttcggtacgtcgtaacgttggttaacttacggtaggttcggtaagttacgtacacgttaacgttacgtaacgccgtaacgttacccggtacggtaacggaccggtactccgttaacccacggtaccctaccgaccgaaggtaaccctaacgtaacggtaaccgttaacgttacgtttacctacttaacgtaanaaccgtaacctaagtacggacggtacggaccgaaccggtaccgacggttaccgttacgtaacgtttcnggtaacggngaacgtacgtcggtacgccgtaggttattacggtttacgtttacttacggtttacgttacgccggtttacgggaccggtacgtacccgg

SEQ ID NO: 44407 - DNA, 1057 bp, Homo sapiens
  misc_feature: GYAE6OF02HHB60.44.55.E11.1.454.CMB.1.raw
  modified_base (201)..(201): a, c, t, g, unknown or other
  misc_feature (201)..(201): n is a, c, g, or t
tcagacagtatatacacgaccggtgctcgatttagcactcgcacgttgggttgggggggagaggagcccagcactgggattccgaggtgtttccattcggtgatcacgcactgaacacagaggactcaccatggtagtttggctgagcgtgggttcttccttgttaggtactttaaaggtcgtcagtgtgaggtggacgtntgagtggtacgtcgtagggagggtacggtcttaacgtccgacggtccgggttcggggggtacccaaggacgtaccgtccttccgttacggtcgacgtaccgtccgttacgtcgggtccgtccgtaccgtacgacgtacgacgtacctaaaccgtactaggtacggtacgggtttacccgggtacccggaccggtaccggtacccggtaaccgggtaacggggggtaaccgggtcggtacgggggtacgggttacgggtcccgttacggtaaccggttaacttaacgttttaacgttccggttacggttacgttaacgtttaccgtaaccttaaccgtttaacccgtaaccgtacgttaaacccgggtacccgtttaacccggggtaacgggtaaacccgggggtaccctttaaccgtttaacccgaaccgtttaaccggtaccccggttaaaccgggtaaaacgggttaaacccgttaaacccgttaaaccgggtaaaaccgggggtttaacccttttttaaacccggggtttaactttaacccggttttaaaaaccgtaaaccgggtttaaacccgaaaaccccgttaacgggttaacggggaaaccggggtacccggtaaacccgggttaaaccggaacccccgggtttacccggggttaaccccttttaacgtttaaaccgggtttaccggttaccgggtacggtaaaccccgggtagggtaaacccggtgggtacccccgggtaacggtaccgggttttaacgggtaggtttttaacggtttaccttttacgggttttaccggtttacgacccggggtttaccgggttacccgggaccgttaaccccggggg

SEQ ID NO: 44408 - DNA, 700 bp, Homo sapiens
  misc_feature: GYAE6OF02HT484.44.55.E11.1.454.CMB.1.raw
  modified_base (377)..(377): a, c, t, g, unknown or other
  misc_feature (377)..(377): n is a, c, g, or t
tcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggtctccttgttggtacttttaaaaggtgtccagtgtgaggtgcggctgatggagtcgtggaggaggcttagtccgaggccggtcgggggtcccaggacgactccgtccgtgtcgccacgcctcgtcgggcctccgaccgtacgagaccgacgactaacctacgtagtcggtaggttccggtcccgacccgaggtccgtaccggaacgggggaagggtcgtacgggngggtcgggtcctacgagttacttaacgtttacgttacgttggtagttacttttacaacgtacgttaacccgtacgaccgtagtacccgtcgtaggacggtaccgtacgtaccacgtcgtcaccgaacggtactacgttacaacggtacgtacggtttactacttaactaacgtacgaaccgaacgtggaaacggtcggaaccgaaccggacgtaccgtaccgtacgttacgttcgtagtacgtacgtagacgtacggtcgcgttccgtaggtcgtttacggttatttacgttcgttacgtccgttcggtaccggcgtaaccgg

SEQ ID NO: 44409 - DNA, 857 bp, Homo sapiens
  misc_feature: GYAE6OF02IL3PM.44.55.E11.1.454.CMB.1.raw
  modified_base (198)..(198): a, c, t, g, unknown or other
  misc_feature (198)..(198): n is a, c, g, or t
tcagacagtatatacacgaccggtgctcgatttagcactcgcacgttgggtttgggggggagaggagcccagcactgggattccgaggtgtttccagttcggtgatcagcactgaacacagaggactcaccagtggagttttggctgagcgtggttctcgttgttggtacgtttaaaaggtgtcagtgtcggaggtgnggctgagtgtagtctgggaggaggtcgttaagtccgacgtcggtcgggggtaccaggacgtaacgttcctaccgttggttgccgtacgccttacggtcggtccttaccgaccgtacgacgacgactactaaactacagtcggtaggttccggccgtacgacggccgtacggtaagggacgggtcgtaggtcggtacgggtctcgtaacgtacgttaaactttacgttacggtaggttcgttaacgtttaccgtaaccgttaacttaaacccgttaccgaccggttaaccgtaaacccgtttaacggggaccgggaaacccggtacggttaacctttaacccggtaaccctaactttccccgggtaaaccggtaacgggtaaacccgtaaacgtttaaccgtaacggtaaaccgttacggttttaacgttaaacttaaaccggttaaaacgaacgttaaaacccgaagttaacgaaacggtaacggtaccgaaccggttacccgaccggttaaccttaacgtagtttaaccggtgaaccgttaacgacgtaaccgttaacggccggtaaccgtacggttaaccgggttgttaacggttttaactttacggtttcggttaccgttaacggtttccgggtaacggtacccggtaaccccggg

SEQ ID NO: 44410 - DNA, 764 bp, Homo sapiens
  misc_feature: GYAE6OF02JORLK.44.55.E11.1.454.CMB.1.raw
  modified_base (698)..(698): a, c, t, g, unknown or other
  misc_feature (698)..(698): n is a, c, g, or t
tcagacagtatatacacgaccggtgctcgatttagcactcgcacgttgggtttgggggggaggaggagcccagcactgggattccgaggtgtttccattcggtgatcagcactgaacacagaggactcaccatggagttttggctgagcgtcgggttctccttggttggtacgttttaaaaggtcgttaccaggtgtggtaggtggcggcgtgagtggtagtcgtagggtaggagggtaccgttaggtccgacggccggttcggggggttacccgaaggacggaccttccgtccgtgtcggcgacgtccgtcgtcggctccaccggtcagcacgcgaactacgagtacggtagggtttacgggcccgtaccgacggtacccgtaccgggaacgggggtaagggccggtgggtacgggttcgggttccgtacggtaggttacctaagttttacgtacggttaggtacgttacttttacgacgtacttacgtacgcgtaacgtaccgttaccggagggaacggtcctaacgttcccaacgtacttccgtaaccggaacgggtacctaacgttaaccgggaacgtaacgttaccggtttactattaacgtaaactacggaaacctaccgtagggacacggctaaaccgccgaacgtcctacgttagtactggtacgacgtagaccggtggtcgtaccgggnttaccgggtagttaggtttattaccggtttcgtccggttaccgtcggtacgggtacccggtaccgg

SEQ ID NO: 44411 - DNA, 692 bp, Homo sapiens
  misc_feature: GYAE6OF02JDBX4.44.55.E11.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
tcagacagtatatacacgaccggtgctcgatttagcactcgcacgttgggttgggggggagaggagcccagcactgggattccgaggtgttccattcggtgatcagcactgaacacagaggactcaccatggtagttcggctgagtctgggtttcttgttgttatttacagtntacagagtgaagtgcaggttggtggagtccggggganacttggtccagccgtgggacggtcctgacgtacctctcgtggtcgtccgtcctgtacgtcttaccgacctattcgacgtacgaacctacgtactacggtacgtacgtcgggtacccgacgacggtacgtaccggaggggaacgggctagggaggtcggcgttccggaccgtactaacgtaaaacgtagttcgacctagtacttaacacgacgacgtacgtacggtccgtacgtcgttagacgaacgactacgtattacccgaccttctacgaaagtaacgtacgttacgtactaactaaccgtaactacgtagttacgtactagtacgtacctaagtacgaaccttaaccgtaacgaaacgggtaccaaggtcggaactagttacgtaacgttagttcgtacggtttgttacggttaacacgttaccggtaagttactacgtacggtcgtaccgggcccggtaaggtacccgtgtaacccgg

SEQ ID NO: 44412 - DNA, 954 bp, Homo sapiens
  misc_feature: GYAE6OF02FJC9L.44.55.E11.1.454.CMB.1.raw
  modified_base (346)..(346): a, c, t, g, unknown or other
  misc_feature (346)..(346): n is a, c, g, or t
tcagacagtatatacacgaccggtgctcgatttagcactcgcacgttgggtttgggggggagaggagcccagcactgggattccgaggtgtttccattcggtgatcatcactgaacacagaggactcaccatggactttgggctgagatgggttttcctgttgctcttttaagaggtggccagtgtcaggtgcagctagtggagtcgtgggggagagccggcccaggcctggggaacctcccgtggacgtactcgtcctgtcgcctacggccttcgtggactttccattccttcgaacggtaccccttattcggaccctagttctaccgtacgtcggggttacccnccgtagggtacccttaccggacgggtccggtaaacggggggccttagggggtaacggttgggggtacgtaccgtaaaagttttacgtaacgttacgaaacggtaaacggtaagtttaaggggaaactttacgggaaaacggtaaacctaacgggttaaaccggaacggttaaccccgtaccgggaaacgggtaaaccgggggttacccgttaacggtttacccgtaaaccccgggttaccgtaacccggtaaacgggtaaccgggtaaaccccgttaaaccggttttaaccccgggaaaaccgggtaaaacccgttaaacccgtaacccggttaacgggtaacccttaacgtttacccggttaaccggttaaacccgttaaaacgttaacccggttaaaacccgtaaacccccgttaactaaaacccggtaacggttaacggtaaacgggaaacccggttacccggttacgtttaccgttaccttaacggttttaacgtaacggttaccgggtaacccggtacccggtaacccggtaccccccgttaacggggttaaacccgggtacccgggtaccccccgttagggtttacccggtaaaccccgggg

SEQ ID NO: 44413 - DNA, 836 bp, Homo sapiens
  misc_feature: GYAE6OF02GGZQ3.44.55.E11.1.454.CMB.1.raw
tcagacagtatatacacgaccggtgctcgatttagcactcgcacgttggggtttggggggggagaggagcccagcactgggattccgaggtgtttccattcggtgatcagcactgaacacagaggactcaccatggtagttttggctgagcgtggttctcttgttgtactttaaaggtgtcagtgtgaggtgcggctgagtggtatcgtgggaggaggtcgttacgtccgaggccggtcgggggggtaccagtaacgacctctccgtgtcgcgacgcctcgtcgggcctaccgaccgtcacgacacgactaactactagtggtacggttcggtcccgaccggaggtcctaccgggaggggtacggggcggttgggacgtcgggtcctagtagttacttagtttagtacggtcggttgtactttacgaaccttagttaaccgtacggtacgtaacgtaccggttacggtacgggtaacgggtacccgttaactaccgtaacccgtacgtacccggttacgggaaccgggtaacttaacccgttaaccggttaaacgggttaaacccggttaaccgttttaaccgttacctttaaaaccgtaacgtaaaacccgttaaccggaaacccgtaggtaaccggggtaccggtaacccgggtaaccgaacccgggtaccgggttacccgtttaccgttaaccgtttaacgtcggtaacgggtaacgaacggtaccgtaacgggtccgggaccgttaccggtacgggttacgtttacgggtttacttttacgtttcgggttaggttacccggtttgggtacccggggtacggttaacccgggg

SEQ ID NO: 44414 - DNA, 634 bp, Homo sapiens
  misc_feature: GYAE6OF02FJINB.44.55.E11.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagacagtatatacacgaccggtgctcgatttagcactcgcacgttggggtttgggggggagaggagcccagcactgggattccgaggtgtttccattcggtgatcagcactgaacacagaggactcaccatggtagttttggctgagctgggttctccttgttaggtacttttaaaaggtgtccagtgtgaggtgcggntgatggagtcgtggaggaggcttagtccaggccgtggggggtcccagacgactctcctgtgctagcctcgtgggctacgaccgtcagcagcaactanatggagttcgggtcccncgaggtcgtaccggaggggaacgggctgggaggtgggtctacgagttctagttttacncgttagggttntaacgttttcacgtactaccgtacgactaagtaccgttccgtaggaacggtaccgtaagttccaaccgtactccgaccggtaacgacgtaactacgaaggtacgttacgttactgttaacataacgactacgagacgaggaccgacgacgtcggacttacttaacgtgcgtcgacgagacgacgtcgcggtctacgggtagttacgttagttactttacggttctacgttggtaccggtacggtacccgg

SEQ ID NO: 44415 - DNA, 510 bp, Homo sapiens
  misc_feature: GYAE6OF01ESZN6.7.85.H08.1.454.CMB.1.raw
  modified_base (504)..(504): a, c, t, g, unknown or other
  misc_feature (504)..(504): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccgagggagggctgcagtgggtttcacacattaatactggaagtaggacataacttacacagactctgtgaagggccattcaccacctcagagacgacgccaagactcactgtctctgacaatgaacagcctgagagtcgaggacacggctgtgtattcgtgtgacgagagagtccgggaggggactagtcgaccngtacgg

SEQ ID NO: 44416 - DNA, 531 bp, Homo sapiens
  misc_feature: GYAE6OF01DBFO6.7.85.H08.1.454.CMB.1.raw
  modified_base (496)..(496): a, c, t, g, unknown or other
  misc_feature (496)..(496): n is a, c, g, or t
  modified_base (525)..(525): a, c, t, g, unknown or other
  misc_feature (525)..(525): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttgggctgtgctgggttttccttgttgctattttagaaggtgtccaatgtgaggtgcagctggtggagtcgtgggggaggcttggttcagccgtggggggtccctgagactctcctgtgcagcctctggtatttaccttcagtacttatggcatgaacgtgggtccgccaggctccgagggagggctgcagttggttcacacattaatacgtaggaagtaggaccaataacttacacagactctgtagaagggccgattccaaccacctccaagacgacgacgaccaagaacctcactgtctctgacaaatgaaacagcctagagagtcgaaggacacggctgtgttatacgtgtgagngagacgggtaccggagggactagcgaccngtacgg

SEQ ID NO: 44417 - DNA, 518 bp, Homo sapiens
  misc_feature: GYAE6OF01EZ7M7.7.85.H08.1.454.CMB.1.raw
  modified_base (346)..(346): a, c, t, g, unknown or other
  misc_feature (346)..(346): n is a, c, g, or t
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagccgtggggggtccctgagactctcctgtgcagcctctggatttaccttcagtacttatggcatgaactgggtccgccaggctccgagggaagggctgcaggtgggtttcacacattaanacgtggaagtaggacaataactacacagactctgtgaagggccgattcaccacctacagagacgacgaccaagaactcactgtctctgacaatgaacagcctgacgagtcgaggacacggntagtgtattacgtgtgacgagagagtcggaggggactagtcgacgngtacg

SEQ ID NO: 44418 - DNA, 667 bp, Homo sapiens
  misc_feature: GYAE6OF01BFZQD.7.85.H08.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttccttgtgctattttagaggtgtccaatgtgaggtgcagctggtggagtcgtgggggaggctttgggttcagccgtggggggtccctggagactctcctgtgcagcctctggatttaccttcagtacttatggcatgaactggtccncagctcgagggaggctgcagtggttcacacattaanactggaataggaccagtaactacacagactctagtgaacgggcaacttcaaccctacctaccaggacgacgacgtacccaaagaacctcgactcgtacctcgttacgaactaaagttcgaaaccacggtaccccgttaggaacgggtaacggttaccggaacgggtaacccgaccggggttacgtttaacgggtacggttttaaaccgttaccggttagggtacggtacccgggtaaaggggtaacgttaaaccgggttaccccggggggtaagggggtaaacccggtttaaacggacgggtaaacccccgttaagggtttaacccggg

SEQ ID NO: 44419 - DNA, 524 bp, Homo sapiens
  misc_feature: GYAE6OF01CQX5V.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaggtgtccaatgtgaggtgcagctggtggagtcgtgggggaggcttggttcagcctgggggggtccctggagactctcctgtgcagcctctggatttaccttcagtacttatggcatgaactgggtccgccaggctccgagggaagggctgcagtgggtttcacacattaatactggaagtaggaccataactacacagactctgtgaggccattccaccacctccagacgacgacgaccaagaactcactgtctctgacaaagtgaaccagacctgagagtacgaggacacggctgtgtattactgtgacgagacgagtccgggaaggggtacgtatcggaccagtcgg

SEQ ID NO: 44420 - DNA, 518 bp, Homo sapiens
  misc_feature: GYAE6OF01BTZLO.7.85.H08.1.454.CMB.1.raw
  modified_base (377)..(377): a, c, t, g, unknown or other
  misc_feature (377)..(377): n is a, c, g, or t
  modified_base (514)..(514): a, c, t, g, unknown or other
  misc_feature (514)..(514): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcaggcctggggggtccctgagactctcctgtgcagcctctggatttaccttcagtacttatggcatgaactgggtccgcaggctccgagggagggctgcaggtggttcacacattaatacgtggaagtaggaccaagtaactacaacagactntgtgaaggccgattccaccacctccagacgacgacgaccaagactcaacctgtcctctgacaaatgaacagcctagagagtcgaggacaacggctgtgtattactggtagcgagagagtccggagggactagcgacngtcg

SEQ ID NO: 44421 - DNA, 537 bp, Homo sapiens
  misc_feature: GYAE6OF01D7KJH.7.85.H08.1.454.CMB.1.raw
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctggagactctcctgtgcagcctctggatttaccttcagtacttatggcatgaactgggtccgcaggctccgagggagggctgcgagtgggttcacgacattaatacgtggaagtaggaccataaacttacacagactctgagaaggccattcaccactccagagacgacncaagactcactgtctctgacaaatcgaaacngacctgagacgtcgaggacacggcttagtgtaattacgtggtgacgaggaggtagcccggggaaaggggtaccttaatccggaacgtgtaccgg

SEQ ID NO: 44422 - DNA, 508 bp, Homo sapiens
  misc_feature: GYAE6OF01A5YU7.7.85.H08.1.454.CMB.1.raw
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctggggggaggcttggttcagcctggggggtccctgagactctcctgtgcagcctctggatttaccttcagtacttatggcatgaactgggtccgcaggctccgagggagggctgcagtgggttcacgacattaatactggaagtaggaccataacttacacagactctgtgagggccattcaccacctccagagaccgacgaccaagactcactgtctctgacaaatgaacagcctgagagtcgaggacaggctgtgtattactgngcgagngagtccgggagggactancgaccngtcg

SEQ ID NO: 44423 - DNA, 655 bp, Homo sapiens
  misc_feature: GYAE6OF01CHPF5.7.85.H08.1.454.CMB.1.raw
tcagcgtgtctctacacgaccggtgctcgatttagtatcactcagttcggcggggctctcagagaggtgccttagacctggattccgtaagggcatttaccacttggtgactcagtctactgaacacagaggactcaccattcggagttggggcgtcgtgtcctgggttttcccttgttagctattttagaaggtgtccaatgtgaggtgctagctggtggagtcgtggggaggcttggttcagtcctgggggtccctgagacctctcctgtgcagcctctggactttaccgtcagtacttatggctatgaactgggttccgccgagggtccgtccgaagggaagggcctgccaggtgggttcacgactattaagtacgtaggaagttaggaacctaagtaacttacacagtactctgtgaacgggcattccaccacctcagacgcgacgcctaagacctcactgaccttctagtactaaaattgaaaccgtacggacccgttaggacgtaacggttcgaacggggaacctaaccgggtccttacggttacgttaaacgtttaccgtacggttaggaccggtacggaacggtaaccggttaccccgggtaaggggggttacccgtaaggtaccgggtaccgtaacggttaaccgg

SEQ ID NO: 44424 - DNA, 565 bp, Homo sapiens
  misc_feature: GYAE6OF01C4TGG.7.85.H08.1.454.CMB.1.raw
  modified_base (560)..(560): a, c, t, g, unknown or other
  misc_feature (560)..(560): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctggagactctcctgtgcagcctctggtatttaccttcagttacttatggcatgaactgggtccgccaggctccgagggaaggggctgctaggtgggtttcacactattaatacgtggaagtacggaccataactacacagactcgtgtagaacgggccgtacttccaccctaccgtccaaggaacgacgaaccgaccaaagactcaactgtcctcgtgacaaatcgaacagcctaggagacgtacggagaccgacggtctggtacgttattacgtggtgacggagacgacgtcggggaaggggtactagtcgaaccgngtacg

SEQ ID NO: 44425 - DNA, 649 bp, Homo sapiens
  misc_feature: GYAE6OF01CPTT2.7.85.H08.1.454.CMB.1.raw
  modified_base (495)..(495): a, c, t, g, unknown or other
  misc_feature (495)..(495): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaggtgtcaatgtgaggtgcagctggtggagtcgtgggggaggtcgttggttcaggccgtggggggtccctgacgactctccgtgtgcagcctcgtggtactttaccttcagttacttatggctagtagtaacgtcgggtcccgccgacggcctaccggaggggaaggggctggcgtaggttcgggtttacaacgtactaatttaaacgtacgtaagggtaagtaacggaacctaattaacctaacactagtactcgtgtacggacgggtcctattaccacctacctacagacgacgaccgaccaagacctcacgtcgtctntacgaactaactacgaaaccagtcccgtaggaacgtacggtaccggaacggaccgaaccggtcttaggtacgttacgtttacggtggtacggacggtaggaacggtacggtaccggggaaggggtaccctaaggtaccgacccgtagttaccgg

SEQ ID NO: 44426 - DNA, 584 bp, Homo sapiens
  misc_feature: GYAE6OF01DKHPR.7.85.H08.1.454.CMB.1.raw
  modified_base (459)..(459): a, c, t, g, unknown or other
  misc_feature (459)..(459): n is a, c, g, or t
  modified_base (473)..(473): a, c, t, g, unknown or other
  misc_feature (473)..(473): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggtactttaccttcagtacttatggctatgaacgtgggtccgccgacggcctccgaggggaacgggctgcaggtgggttcacactattaatactaggaagtaggacctaataactacaacagactctgtaggaacgggcctattccacctacctccaaggacgacgacgaccaaagaacctcactgtcctactnacaaagtcgaaacngacctagagacgtcggaaggcacggtctaggtagttaacttacggtggtagacgaaggacgtacggttaccgggggaaggggtacctagttaccggaccgtagttaccggg

SEQ ID NO: 44427 - DNA, 523 bp, Homo sapiens
  misc_feature: GYAE6OF01DBBF2.7.85.H08.1.454.CMB.1.raw
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (517)..(517): a, c, t, g, unknown or other
  misc_feature (517)..(517): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttacccttcagtacttatggcatgaactggtccgccaggctccgagggagggctgcagtggtttcacacattaatactggaagtaggaccaataacttacacagactctgtagaacgggccgaattcacccacctccagacgacgacgcaagactcactgtctctgacaatgaaacngacctgagngtcgaggacacggntgtgtattacgtgtgcggagacgagaccggggagggtacgtagcgaccgngtacgg

SEQ ID NO: 44428 - DNA, 625 bp, Homo sapiens
  misc_feature: GYAE6OF01DX9D6.7.85.H08.1.454.CMB.1.raw
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgctattttagaagtgtccaatgtgaggtgcagctgggtggagtcgtgggggaggcttggttcagccgtggggggtccctgagactctcctgtcgcacgcctcgttggacttttaccttctaagttacttagtggctatgaacgtgggtcccgcaggctccgagggagggctgtagtgggtttcacactattaatacgtaggaagtaggacctaataaaccttacactagactcgtagacgaacgggcctacttcacccacctaccgagacgacgacgacaagaacctcactgtactctanacctaaatcgaacncgtacctaggaacgacggttccgaaacgggacccgtacggacgttcggttagttaacttaacgttggtacgggacggtaaggtacggtacggttacccggggaaggggtaaccttaggaacgaacccggtagttacggttaacccggg

SEQ ID NO: 44429 - DNA, 558 bp, Homo sapiens
  misc_feature: GYAE6OF01DQ60R.7.85.H08.1.454.CMB.1.raw
  modified_base (277)..(277): a, c, t, g, unknown or other
  misc_feature (277)..(277): n is a, c, g, or t
  modified_base (446)..(446): a, c, t, g, unknown or other
  misc_feature (446)..(446): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggatttaccttnagtacttatggcatgaactgggtccgccaggctccgagggagggctgcaggtggttcacacattaatacgtggaagtaggaccaagtaacttacacagactctgtggaaggccattccaccacctcaagagacgacgaccaagactcactgtctctgacaaatgaaacngcctagaggtacgtacggaaggaccgacggtcttaggtagttacgttacgtggtagcggaaggacggtacgtacccggggaagggggacttagtacggaccgtagtaccggg

SEQ ID NO: 44430 - DNA, 518 bp, Homo sapiens
  misc_feature: GYAE6OF01AKI3B.7.85.H08.1.454.CMB.1.raw
  modified_base (482)..(482): a, c, t, g, unknown or other
  misc_feature (482)..(482): n is a, c, g, or t
  modified_base (512)..(512): a, c, t, g, unknown or other
  misc_feature (512)..(512): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggagggctgcagtgggtttcacgacattaatactggaagtaggaccataacttacacagactctgtgaagggccattcaccacctccagagacgacgaccaagactcactgtctctgacaatcgaacagcctagagagtcgaggacacggctgtgtattacgtgtgacgngacgagtccgggaggggactagtcgaccgngtacgg

SEQ ID NO: 44431 - DNA, 529 bp, Homo sapiens
  misc_feature: GYAE6OF01BWY11.7.85.H08.1.454.CMB.1.raw
  modified_base (420)..(420): a, c, t, g, unknown or other
  misc_feature (420)..(420): n is a, c, g, or t
  modified_base (469)..(469): a, c, t, g, unknown or other
  misc_feature (469)..(469): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggagcttggttcagccgtggggggtccctgagactctcctgtgcagcctctggatttaccttcagtacttatggcatgaactgggtccgccaggctccgagggagggctgcagtggttcacacattaatactggaagtacggacataacttacacagactctgtagaagggccattccaccacctccagacgacgacgaccaagaacnctactgtactctagacaaatcgaacagcctagagagtcgaggacacggntgtagtattacgtgtagcggagagtacgtccggggaagggacgtagcgaccgtagtacgg

SEQ ID NO: 44432 - DNA, 1083 bp, Homo sapiens
  misc_feature: GYAE6OF01BGVYV.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagcgtggtggagtcgtgggggaggtcgttgggttcaggcccggttgggggggtccccttggacggtaccttccttccgtggtcgccacggtccttcgtcggtaacttttaccctttcgtaacgttaaccgttttaagtcgggtacctagttacggaaaccgtttcgggggttaccccggcccgtaacggggtcccgttacccgggaagggggggtaaacgggggggtccgttcgggaccggtaagggttttccggggggttttaacctaaccgttaaaccgtaaacgttttaaaacgtttaacccggtttaagggggtaaaacggtttaaaccggggtaaacccctaaacggtttaaaaaaccctttttaaacccgaaaacccggttaaaccggtaaacccgtttaccccggtttaagggttaaacggggtaaaacccgggggtaccccgggttaaaacgttttacccccgaaaaccccccgtaacccccggttttaacccccggaaaacgggtaaacccgggtaaaaccccgggtaaacccggaaaccccccggtaaaaaccggttaaaacccccgtttacccgtaaaccccgtttacccgggtttaacccctaccgttttaacccgggaaccgttaaaaaaccgttaacggtaaaacccgtaacggttaaacccggtttacgggaaacgggttaaaccgggttaccgggtaaacggggaaccccggtaaaccggggtacgtttaaccgggtttacgggtttaaactttaaccgggttacgggtaacgggtaccgggtaaaggggtaaccgtaaccgggttacccggggggtaaacgggggttaaccgttaaaggttacccggtaaccgtaacggtttaacccgggg

SEQ ID NO: 44433 - DNA, 576 bp, Homo sapiens
  misc_feature: GYAE6OF01CT0AP.7.85.H08.1.454.CMB.1.raw
  modified_base (467)..(467): a, c, t, g, unknown or other
  misc_feature (467)..(467): n is a, c, g, or t
  modified_base (488)..(488): a, c, t, g, unknown or other
  misc_feature (488)..(488): n is a, c, g, or t
  modified_base (569)..(569): a, c, t, g, unknown or other
  misc_feature (569)..(569): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagctggtggagtcgtgggggaggcttggttcagccgtggggggtccctgagactctcctgtgcagcctctggtactttaccttcagttacttatggctatgaacgtgggtccgccaggcctaccgaggggaagggctggcgtaggttgggtttacacgactaattaatacgtaggaagtacggacctaagttaaacctacaacagactcgtgtagaacgggtccgtaattccaaccctacctcaagacgacgacgaccaagaactcacgtntactcgtgacaaagtgaaccngcctagagtagcggaagcacggtctgtagttattacgtggtcgacgtaggagtacggaccgggaagggtacctagacgacngttacgg

SEQ ID NO: 44434 - DNA, 545 bp, Homo sapiens
  misc_feature: GYAE6OF01CP18E.7.85.H08.1.454.CMB.1.raw
  modified_base (308)..(308): a, c, t, g, unknown or other
  misc_feature (308)..(308): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcgttggttcaggccgtggggggtccctggagactctcctgtgcagcctctggatttaccttcagttacttatggcatgaacgtgggtccnccaggctccgagggacgggctgctaggtggttcacactattaatacgtagggaagtaggaccaataacttacacagtactctgtagaagggcctattaccaccaccgtaccagacgacgaccgaccaaagacctcactcgtctcagacaaatcgaacagccgtagagagtacgaaggacaccggtntagtntagttacgtgtgacgagacgngtccgggagggtctancgacngtcg

SEQ ID NO: 44435 - DNA, 607 bp, Homo sapiens
  misc_feature: GYAE6OF01DYHBU.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagccctctggtacttttaccttcagtacttatggcatgaacgtgggtccgccaggcctccgaggggagggctgcaggtggtttacacactattaactacgtagggaaagtacggaacctaattaaaccttacaacgtacgactcgtagtaggaacgggccgtaattacccaccctaacctccgaagacgaccgaacgaccaaacgaacctcactcgtactactacgaacaaatcgaaacacgaccgtaggagtacggtacgaggaccacggtctaggtgtattacgtggtacgcggaaggacggtacggtacccggggtaggggtaacgtagtcggaccgtagtaccgg

SEQ ID NO: 44436 - DNA, 575 bp, Homo sapiens
  misc_feature: GYAE6OF01DD0NG.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctggggttttccttgttgctattttagaaggtgtccaatgtgaggtgcagctggtggagtcgtgggggaggcttggttcagccgtggggggtccctgagactctcctgtgcagcctctggtatttaccttcagtacttagtggcatgaacgtcgggtccgccgaggcctccgaggggaagggctgcaggttgggtttacacacaatttaatacgtaggaaagtaggaccaattaacttacacagtactcgtagtggaacgggccgtattccaccctacctccgagacgaccgacgaccaagactcactcgctcgtacgacaaagtcgaaacacgactaggagacgtacgaaggaccacgggtcttggtcgtagttacgtggtagacggaagacgagtccgggaggggtaactgtacaccgtatacgg

SEQ ID NO: 44437 - DNA, 774 bp, Homo sapiens
  misc_feature: GYAE6OF01CXV5G.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggaggttgggctgtgcttgggttttccttgttgcttattttagaaggtgtccaatgtgaggtgcagcgtgggtgggagtcggtggggggaggtcgtttggttcgaggccggtggggggtccctggacgtactcgtcctgtgcacgtcctctggtacttttaccttcagttacttagtggctagtaggtaacgtcgggtacccgccgacggccgtaccggaaggggaacggggtcttggcgtaagggtttgggttaccaacctaactaaagtttaaactacgtaagggtaaaggtaacggtaaaccctaaattaaaaccttaaccaacgtaacgacctttacgttacggttagggaaccggggtccctaactttacccgaacccctacccgtaaccaagggaacgaaccggaacgtaacccaaagtaacctccgaacttcgtcctacgtacgaactaaacgtacgaaaccgacgtcccgtaaggaaggtaacggtacggaaccgggaaccgtaaccgggcctttagggttaacgttaaacgtttaccgggttagggttacgggaacggaaaggtaaggggtacccgttaaccggggggaacgggggttaaacttaggacggaaaaccctgggttaacccggg

SEQ ID NO: 44438 - DNA, 670 bp, Homo sapiens
  misc_feature: GYAE6OF01DI2AF.7.85.H08.1.454.CMB.1.raw
tcagcgtgtctctacacgaccggtgctcgatttagtatcactcagtcgcggggctctcagagaggtgccttagccctggattccaaggcatttccacttggtgatcagcactgaacacagaggactcaccatggagttgggctgtgctggttttccttgttgctattttagaaggtgtccaatgtgaggtgcagctggtggagtcgtgggggagtcgtttggttcaggccgtcggggggtccctggacgaccttctccgtgtgcacgcctcgtggtactttaccttctagttacttagtggactagtacgtaacgttcgggtcccgaccgacggtccgtaccggaaggggaacgggctacggcgtaggttcgggtttacaacgtaacgtaatttaaacgtacgtagggtaaaggtaacgtaaccgtaataaaccttaacaacgtaagtacgttcgtaggtaggaacgggcctaattacccaaccctacctaccgaagacgaaccgtaacgaccaaagacctacaactcgtctacgtacgaacaaagtacgaacacgtccgaggaacgtacggtacgaacggtaccgacggtagttgtacgttattaacggtgtacggacgaaggtacgtacggtaccggggagggtactaagtcgaccgtagttacccgg

SEQ ID NO: 44439 - DNA, 551 bp, Homo sapiens
  misc_feature: GYAE6OF01AR1JU.7.85.H08.1.454.CMB.1.raw
  modified_base (508)..(508): a, c, t, g, unknown or other
  misc_feature (508)..(508): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggattaccttcagtacttatggcatgaacgtgggtccgccgaggcctccgagggagggctgctaggtggttcacgactattaatacgtaggaagtacggaccaataacttacacagactcgtgtagaacgggcctaattccacctacctccagacgaccgacgaccaaagacctcacgtcgtacctcgtcgacaaagtgaaaccagccctagacgtagtcgagacacggtctgtgtagttcgngtacgacgtagagtacgtacgggagggactagcgacgtgtacg

SEQ ID NO: 44440 - DNA, 692 bp, Homo sapiens
  misc_feature: GYAE6OF01EP0OI.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagctgggtggagtcgtgggggaggcttggttcagccgtggggggtccctgagactctcctgtgcagcctcgtggtactttaccttcagtacttagtggcagtcgaacgtcggggtcccgccgacggccgtaccggagggggaaggggctggacgtaggttcgggtttaccaactactaatttaacgtacgtaggtaacggtacggaacctaattaaacttacaacacgacttcgtaggtaggaacgggtcctattcccaaccctacctaccgaaggtaacgaaccggaaccgaccaaagtacctaccacttcgtcctacgtgaacaaagtcgaacacgtacccgtaggaacggtacggtaccggaacggtaaccgacgggtcttaggttacgttaacgtttaccggtggtagggaccggtaaagggtacggtaaccgggttacccggggggtaaaggggttacccttaaggtaccggaacccttaggttacccggg

SEQ ID NO: 44441 - DNA, 666 bp, Homo sapiens
  misc_feature: GYAE6OF01CKAXE.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttgggctgtgctgggttttccttgttgctattttagaaggtgtccaatgtgaggtgcagctggtggagtcgtgggggagtcgttggttcagccgtggggggtccctgagactctcctgtgcagtcctcgtggtactttaccttcagtacttagtggctagtgtaacgtcggtcccgccgaggcctaccgaggggagggctgcgtaggttggttacacactattaatacgtaggtaaagtacgaacctaaagttaaaccttaacaacgagtacgttacgtaggtaacggaacgggtccgtaattcccaaccctaccgtaccgaagacgaacgtaccgacctaaagtacctacgactctctacgtgaacaaacgttcgaaccaggtaccctaggacgtacggtacgaacggtaccgacggtacttaggttagttacttaacggttggtaccggtacggtaaacgggtaaggtacccgggtaaccggggtagggggtaaccttaggaacccggtaaaccgtaggttaccggg

SEQ ID NO: 44442 - DNA, 620 bp, Homo sapiens
  misc_feature: GYAE6OF01CW99B.7.85.H08.1.454.CMB.1.raw
  modified_base (484)..(484): a, c, t, g, unknown or other
  misc_feature (484)..(484): n is a, c, g, or t
  modified_base (527)..(527): a, c, t, g, unknown or other
  misc_feature (527)..(527): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcttgggttcaggtccggtgggggggtccctggagactctccgtgtgcacggtcctcgtggtactttaccgttctagtacttatggctatgaacgtcggtccgccgaggcctaccggaggggaacgggtctggacgtaggttcgggttacacaactagttaaatacgtaggaaagtacggacctaagtaactacaacagactctgtaggaagggcctattccaaccacctcgaagacgacgacgaccaaagactcaactcgtactnacgacaaagtgaacacgtctagaggacgtcgacggacacggtnttaggtgttaacttacggtggtaggaccggtaggaacggtacggtaccgggggtaaacgggtacgtaagtaccggaaccttaggttacccggg

SEQ ID NO: 44443 - DNA, 723 bp, Homo sapiens
  misc_feature: GYAE6OF01CTU12.7.85.H08.1.454.CMB.1.raw
  modified_base (592)..(592): a, c, t, g, unknown or other
  misc_feature (592)..(592): n is a, c, g, or t
  modified_base (658)..(658): a, c, t, g, unknown or other
  misc_feature (658)..(658): n is a, c, g, or t
tcagcgtgtctctacacgaccggtgctcgatttagtatcactcagtcgcggggctctcagagaggtgccttagccctggattccaaggcatttccacttggtgatcagcactgaacacagaggactcaccatggagttgggctgtgcgttgggtttccttgttgcttattttagaaggtgtccaatgtgaggtgcagcgtggtggaggtcggtgggggagtcgttggttcaggccggtgggggtccctggacgactctccgtgtcgcacgtcctgtggtaacttttaccttactagttacttagtcggctagtacgaacgtcgggtcccgccgaacggtccgtaccgggaaggggaacgggtctacgtacgtagggttcggtttacaacgtaactaagtttaaacgtacgtaagggtaaacgtacggaaaccctaaattaaaccgttaacaacgtacgtaaccgttcggtaaggtacggaacgggtccctagttacccaacccgaacctacgaacggaaccgaaccgtaacgaaccctaaaagacccttccgaacgttcgtactaccgtaagaaacaaacgttcggaaaccncggttacgaagtaacggtacggtacggaaccggtacggaccgttgtacgttagttaaacttccggnggtacggacggaacggtaagggtccggtacggggaaggtaaccttgacgttacgaagtttacggg

SEQ ID NO: 44444 - DNA, 745 bp, Homo sapiens
  misc_feature: GYAE6OF01DSR1H.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaagtgtccaatgtgaggtgcagctggtggagtcgtgggggagtctttggttcagccggtgggggtccctgagacctctcctgtgcacgcctcgtggtacttttacccttcgtacgttacttagtggcagttgtaaccgtcgggtccgaccgacggccgtaccggaggggacgggctgcgtaggttcggtttaccactaactaatttaaactacgtaggaaagtacggaacctaaattaaaccttacaacgtacgtaccttacgtaggtacggaacgggtccctaattacccaacccgaacccttccgaaacggaacggaacccggtaacccgaaacccgtaaacgtaacccgtccgtaaccgttcgtttacccttacgttacggaacctaaaacgttacgaaacccgtacggtaacccgttagggaacgttacgggtacggaacgggaccgtaacgggtccctttaggtaccgtttaacgttcggttcggtaggacggtaacggaacgttacggggacccgggggtaaggggtaacccttagttaacggaacccgttaagggttccggg

SEQ ID NO: 44445 - DNA, 822 bp, Homo sapiens
  misc_feature: GYAE6OF01C40ZL.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgtcttattttagaaggtgtccaatgtgaggtgcagctgggtggagtcggtgggggaggtcgtttggttcaggtccggttcgggggggtcccctggacggtacctccgttccgtgtcgccacggtccctcgttggtacttttaccctttcgacgtttaacttagtcggacctagttacggtaacggtttcggggtaccccgaccggacgggtccgttacccgggaagggggaacggggtccgttaggaccggtagggtttccggggttttaccaaaccgtactaagtttaaacgtacggtagggtaaaacggtacggaacctaaacgttaactaacacgaacgtacttacgtagtaacgggacgggtacctacttacccaacctacccgtacaacggtacgaaccggaaccgaaccctaaaggtaacccttccgtaccgttacgtacccgttacgtacggtaaactaaacgtacgaaacccggtaacgttacccgtaaggtaaacggaccgggttaacggaacgggaaccccgtaacgggttccgttaggttaaacgtttaacggttaccggttgggaaggtcccgggaaagtaacggggtaacgttaccccggggggaagggttaacgtagtacccggtaactaacggttacccggg

SEQ ID NO: 44446 - DNA, 629 bp, Homo sapiens
  misc_feature: GYAE6OF01A65DB.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttatttagaaggtgtccaatgtgagtgcagctggtggagtcgtgggggagtcgttggttcaggtccgtggggggtccctggagactctcctgtgcacgcctcgtggtactttaccttcagttacttagtggcagtgaacgtcgggtcccgccgacggctccggaggggacgggctgcgtaggtcggttacacactagttaatacgtaggaaagtacggaactaagtaaacttacgactacgactcgtgtaggacggcgtactaccacctaccgtacaagacgacgacgaccaacgtactacactcgtctctagactaaagtagaaccacgtccgtagacgtacggtacggacggaccgtacggtacgtggttaacgttacttacggttgggagtacgggaaggtaacggaacgggttccggggtaacggggtaaccgtagtccgtaacggttagttaccggg

SEQ ID NO: 44447 - DNA, 737 bp, Homo sapiens
  misc_feature: GYAE6OF01D5K99.7.85.H08.1.454.CMB.1.raw
  modified_base (290)..(290): a, c, t, g, unknown or other
  misc_feature (290)..(290): n is a, c, g, or t
tcagcgtgtctctacacgaccggtgctcgatttagtatcactcagtcggcgggggctctcagagaggtgccttagccctggattccaaggcatttccacttggtgatcagcactgaacacagagactcaccatggagttggggctgtgcttgggttttccttgttgctattttagaaggtgtccaatgtgaggtgcagctggtggagtcgtgggggagtcgttggttcagccgtgggggtccctgagtactctcctgtgactacgtcctcgttggtacttttacccttanaagttaacttagtaggacctaagtgaacgtcgggtcccgccgacggtcgtaccggaggggaacgggctagacgtaggttagggttaccactaaccgtaatttaacgtacgtagggaaagtacggaacctaagtaaacgttacacgaacgtacttcgtaggtacggaacgggtccgtaacttcccaacccgtaacccgtaccaaaggaacccgaaccgaacccgaaccgaaaacggtaacctacgtaccttacggtaccttacgtacgtaacctaaagtacggaaaccgtacgtaccgtagggtaaccgacggtaacggacggaaccgtacgggacttagggttacgttaagtttaccgggtagtaccggtagggtaacgtaacgggtacgggtaaccccggggtagggggtaaacccttaggtaacccggtaaccttggttaaccgg

SEQ ID NO: 44448 - DNA, 740 bp, Homo sapiens
  misc_feature: GYAE6OF01BUVTX.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctgggtggagtcgtgggggagcgttggttcaggccgtggggggtccctgagactctcctgtgcacgcctcgtggtacttttaccttctagttacttagtggcatcgaacgtcggggtcccgccgacggccgtccggaaggggaacggggtctggcgtaggttcgggtttacactaactaagtttaaactacggtagggaaaggtaacggtaacctaacttaaaaccgttaaccaacgtaacgtaccttacggtaggttacgggaaacggggtccctaacttacccgaacccctaccgtaccgaaggtaacggaaaccgacccgaaccgaaacgaacctcctaacgttcgtcctccgtacgaacaaagtacgaacgaacgtacccgtaggtaaggtacggtcggaacgggtaaccgaccggtcgttacggttagttaacgtttacgtacgggttaggaaccggtaggtaaacgggtacgggttaaccgggggtaacgggggttaaccttaaggcccgggtaaacccgtggtttaacccgggg

SEQ ID NO: 44449 - DNA, 715 bp, Homo sapiens
  misc_feature: GYAE6OF01DPJCU.7.85.H08.1.454.CMB.1.raw
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
tcagcgtgtctctacacgaccggtgctcgatttagtatcactcagtcgcgggggctctcagagaggtgccttagccctggattccaaggcatttccacttggtgatcagcactgaacacagagactcaccatggagttggggctgtgctgggttttccttgttgctattttagaaggtgtccaatgtgaggtgcagcgtggtggagtcgtgggggagtcgttggttcaggtccgtgggggtccctgagactctccngtgcncgcctctgacttttacctnagtacttanggcatgaacgtcgggtccgcgacggctaccggaggggaacggggctaggcgtaaggttcgggtttacaacgtactaagttaatacgtagggaaagtacggactaaagttaaacttacacagacttcgtaggtacggaacgggccgtaaacttacccgaccctaaccgtaccgaaagaaccggaaccgtaaacccgaacccgaaacgtaaccctaccgtaacgtttcggtacccttacgtacgaaccgtaaaacgtacggaaaacctacggtacccgtaggaaacggtacggttaaccgggaacggtaacccgtacggggtaccttaggttaccgttaaatttacccggtaggttacggacgggtaaacgtaagggtccgtaacccgggggaggggtaaacccttagaaccgacctaggtacccggg

SEQ ID NO: 44450 - DNA, 580 bp, Homo sapiens
  misc_feature: GYAE6OF01DFFQ8.7.85.H08.1.454.CMB.1.raw
  modified_base (488)..(488): a, c, t, g, unknown or other
  misc_feature (488)..(488): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggagtcttggttcagcccgtggggggtccctgagactctcctgtgcagcctcgtggtacttttaccttcagttacttatggcatgaacgtgggtccgccgaggcctccgaggggaagggctgcgtaggtggttacacactaatttaatacgtaggaaagtaggaacctaataaactacacagtactcgtagtaggaacgggccgtaattccaccctacctccaaggacgaccgaacgaccaaagtacctcactgtactctagacaaatcgaaacngacctgacgagtcgaaggcaacggtctaggtagttattacgtgtgacggaaggacgtaccggacgggtaagggactagacgacctgtaccgg

SEQ ID NO: 44451 - DNA, 605 bp, Homo sapiens
  misc_feature: GYAE6OF01CCABD.7.85.H08.1.454.CMB.1.raw
  modified_base (477)..(477): a, c, t, g, unknown or other
  misc_feature (477)..(477): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctatttagaaggtgtccaatgtgaggtgcagctggtggagtctgggggaggcttggttcagccgtggggggtccctgagactctcctgtgcagcctcgtggtatttacccttcagttaccttatggctatgaacgtggggtccgccgaggcctccgaggggaagggctgcgaggtggttcacactattaagtacgtagggaagttacggaactataaaccttacaactagactcgtggtaggaacgggccgtaattccaccctacctccaagacgaaccgacgaccaagacctcactgtctactgactaaangaaccacgtcctaggacgtacgtcggaacggacaccgggtctaggtacgttatttaacggtggttaggacgggagaacggtacggtacccgggggaaggggtaccgttagacggaaccgtggttacgg

SEQ ID NO: 44452 - DNA, 571 bp, Homo sapiens
  misc_feature: GYAE6OF01DIQ3X.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtcaatgtgaggtgcagctggtggagtcgtgggggaggcttggttcaggccgtggggggtccctggagactctcctgtgcagcctcgtggtactttaccttcagtacttatggcatgaactcgggtccgccaggcctaccgaggggaagggctagcaggttgggttcacacattaatacgtaggaagtaggaccaataacttacaacagtaactctagtaggaagggccgtattaccaccacctcagagacgaacgaccaagactcactcgtctctgactaaagtgaaacagacccgtagagagtcgaacggacgacggcttgtagttatacgtggtaggcgaggtaacgacgttacccggggaaggggtactagtacgaccttgtaaccgg

SEQ ID NO: 44453 - DNA, 764 bp, Homo sapiens
  misc_feature: GYAE6OF01D6KKA.7.85.H08.1.454.CMB.1.raw
  modified_base (139)..(139): a, c, t, g, unknown or other
  misc_feature (139)..(139): n is a, c, g, or t
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
tcagcgtgtctctacacgaccggtgctcgatttagtatcactcagtcggtcgggggctctcagagaggtgccttagccctggattccaaggcatttccgaccttggtgatcagcgactcgaacacagacggactcaccngtgggtagttgggctgtgcttggtttccttgttncttatttagagtntcctaatgtgaggtcnctagtcgtgggtaggacgtcggtggggacgtcgttggttccgacggtccgggtcgggggtcctggacgtaccttctaccgtggtacgcctacgtccttcggtacggttaacttttaccctacgtaacgttacgtttaacggtccgggtaactacgtttaccggaccggtccggggtaccccaccgggtaacgggttccctaccgggggaaaagggggtccggttacgacggtacgttacggggtttaccgttacaacgttaaccgttaagttaaaccgtcggtaaaggtaacggtaccgaactaaactttaacgactagtactcctaggtggtaacggaccgtaacgttctaacccaacctactacgaagtaccgaacgaccaacgtaacctacctacgtacgtactccctagaacgtaactaagacgtaacgtacgtacgtaagaacgtcggtaacgacgtaccggtacgtcggttacgttagtaacgttcggtacggtaacggacggagtaacggtaccggaggggtaccgttaagtccgaacggtctcggttaaaccgg

SEQ ID NO: 44454 - DNA, 562 bp, Homo sapiens
  misc_feature: GYAE6OF01EN7HO.7.85.H08.1.454.CMB.1.raw
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgctattttagaaggtgtccaatgtgaggtgcagctgggtggagtcgtgggggaggcttgggttcaggccgtggggggtcccctgagactctcctgtgcagcctctggatttaccttcagtacttatggcatgaactgggtccgccgaggctccgagggagggctgcagtgggtttcacgacattaatacgtaggaagtaggactataacttacacagactcngtagaagggccgtattccaccacctcagagacgacnccaagactcaactgtacctntcgacaaatcgaaacacgaccgtagaacggagttacgaaggtaccgacgggtctaggttgttaactttcgtggtgacggtacgagtacgtaccgggagggtaactagtcgaacctgtacgg

SEQ ID NO: 44455 - DNA, 518 bp, Homo sapiens
  misc_feature: GYAE6OF01BMZNB.7.85.H08.1.454.CMB.1.raw
  modified_base (379)..(379): a, c, t, g, unknown or other
  misc_feature (379)..(379): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctcgtggactttaccttcagtacttatggcagtgaacgtgggtccgcaggctccgagggagggctgcagtggttcacacataatacgtggaagtaggacataactacacagactctgngaggccgtatcaccactcagacacgacgacaagactcactcgtctactgactaaactgaacacgcctagacgtagtcgaaggcacggctgtgtattacgngtgngagngtagccgggagggactagctaccgngtacgg

SEQ ID NO: 44456 - DNA, 559 bp, Homo sapiens
  misc_feature: GYAE6OF01D4CE6.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttttccttgttgctattttagaaggtgtccaatgtgaggtgcagctggtggagtcgtgggggaggcttggttcagccgtggggggtccctgagactctcctgtgcacgcctctggtacttttaccttctagttacttatggcatgaacgtgggtccgccgaggcctccgaggggagggctgcaggttggttcacactattaatacgtaggaagtaggacctaataactacacagactctgtgaacggcattccaccactcagagacgacgaccaagactcacttcgtctctagacaaagtgaacagccgtaggagacgtacggaaggaccgacggtctggttagttaattcgtggtgacggaggagacgtaccggggaaggggaacttagcgtacccagtaccgg

SEQ ID NO: 44457 - DNA, 562 bp, Homo sapiens
  misc_feature: GYAE6OF01BLB83.7.85.H08.1.454.CMB.1.raw
  modified_base (317)..(317): a, c, t, g, unknown or other
  misc_feature (317)..(317): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaaggtgtccaatgtgaggtgcagctggtggagtcgtgggggaggcttggttcaggccgtcgggggggtccctgacgactctcctgtgcacgcctctggtattttaccttcagttacttatggcagtcgaacgtggggtcccnccgaggcctccggaaggggaacggggctggcgtaggttggtttacacactaattaatacgtaggaagtagacaataacttacacagtactctgagacgggccgtatccacctaccgtccagacgacgacgaccaagactcactntctctgacaagtcgaacagctgagagtacgagacgacgtntgtattagtacgtgtagacggagacgacggtcggggaagggtacgttatcgaccgtgtacg

SEQ ID NO: 44458 - DNA, 584 bp, Homo sapiens
  misc_feature: GYAE6OF01B7YB5.7.85.H08.1.454.CMB.1.raw
  modified_base (499)..(499): a, c, t, g, unknown or other
  misc_feature (499)..(499): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (572)..(572): a, c, t, g, unknown or other
  misc_feature (572)..(572): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggagtcgtgggggaggcttggttcaggtccgtggggggtccctggacgactctcctgtgcagcctcgtggtacttttaccttcagttacttagtggcatgaacgtcggggtcccgcgacggcctccggaaggggaacgggctggcgtaggttggttacactactaattaatacgtaggaagtacggaacctaataacttacaactagtactcgtgtacggaacgggcctacttccaaccctacctaccgaagacgaccgaccgaccaaagacctcacttgtcctctagactaaancgaacagtccagtagcgtacgagacncggntgtgttattcgtgtgcggagacgtacgtccggggaaggactancggactgtacgg

SEQ ID NO: 44459 - DNA, 687 bp, Homo sapiens
  misc_feature: GYAE6OF01DBWC2.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtctttgggttcaggccgtggggggtccctgagactctcctgtgcagcctcgtggtacttttaccttcagttacttatggctatgtaacgtgggtcccgccgaggctccgaggggaagggctggcgtaggttgggtttacacgactaattaagttacgtagggtaaagtacggaacctaaattaaaccttaaccgaacacgtaacttcgtggtacggaacgggacccgtatttacccgaaccctacccgtccaaggaacgtaaccgaaccgaccaaacgacctaccaccttcgtcctctagaactaaatcgaacctagacccgtaggaacgtacggtaccggaacgggacgaccgggtcttaggtacgttaacgttaccgttagggtacggtacggaaaggtaacgggtaccgggtacccgggggtaagggggtaaccgttaagtaccggaacccgttaggttaacccgg

SEQ ID NO: 44460 - DNA, 554 bp, Homo sapiens
  misc_feature: GYAE6OF01ALX8N.7.85.H08.1.454.CMB.1.raw
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctatttagaggtgtccaatgtgaggtgcagctggtggagtcgtgggggaggcttggttcaggccgtgggggggtccctgagactctcctgtgcagcctctggatttaccttcagtacttatggcatcgaacgtcggggtcccgccgaggctccggaggggaacggggctggctaggtgggtttcactactacgttaatacgtggaagtacggaccaataactacacagactctgtaggagggccgattccacccacctcgagacgaccgacaccaaggactcgactgtctctgacaagtgaacngccnggagacgtcgaaggaccacggtctaggtgtattaccgtggtcgngagagtacgtccgggaagggtctagcgacgtgtacgg

SEQ ID NO: 44461 - DNA, 566 bp, Homo sapiens
  misc_feature: GYAE6OF01CTNBJ.7.85.H08.1.454.CMB.1.raw
  modified_base (311)..(311): a, c, t, g, unknown or other
  misc_feature (311)..(311): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcttggttcaggtccgtgggggggtccctggagactctcctgtgcagcctctggtatttaccttcagtacttatggctatgaagttgggtccnccgaggctccgaggggagggctgcgagtgggttacacgactattaatacgtaggaagtacggactaataactacacagactcgtgtgaacgggccaattcaccacctcaagacgacgacgaccaagactcgactgtcctcgtcgacaagtacgaacacgaccgtagagacgtcgaaggccacggtctggtacgttattaccgtggtagcggaaggacgacggtccggggagggacgtatacggacctagtaccgg

SEQ ID NO: 44462 - DNA, 1023 bp, Homo sapiens
  misc_feature: GYAE6OF01B6X50.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagaggactcaccatggagttggggctgtgcgttgggttttccttgttgcttattttagaaggtgtccaatgtgaggtgcagcgtggtggagtcggtgggggaggtcgtttggttcaggtccggtcggggggttcccgtggacgacctccttccgtggtgaccgacgtcccttcgttacggttaactttttacccgtttaccgtaaggtttaacttttaacgtgggtacctaagttacggtaaaccggtttcggggttccccgacccggtacggggccccgtttacccgggaacggggggtaacgggggtccgttacgggtaccggttaacggggttttcgggggttttaacctaaacccggtaactttaaaacttttaaaacggttaaccgggtttaaacgggggttaaaaacgggttaaccggggttaaaaccccttaaaacgtttaaaaacccgtttaaacccgtaaaccgtaaacggttaacccgttttaccggttaacggggttaacggggtaaaaccgggggttaccccggttaacctttaaccccgtaaaccccctaaccccggttaacccccgaaagggtaaaccccggtaaacccgggaacccccggtaaaaccctaaaaccggaaacccgtttaccccgtaaacccgtttaccggttaccccgttaccgtaaccggtaaaccgtaaaaacgtttaccgaaaacccgttacgaccccggttaagggtaaacgggtaaccggtaacggggtaacccgggaaccggtaccgggtacgtttacgggttaccggtttaaacgtttacccgtgggtaaccgggacggtaaggtaaccggaacggggtttacccgggaagggggttaacttaaccggtacggtaaccgtggttaacccggg

SEQ ID NO: 44463 - DNA, 601 bp, Homo sapiens
  misc_feature: GYAE6OF01EABMY.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttcctgttgctattttagaaggtgtccaatgtgaggtgcagctggtggagtcgtgggggaggcttggttcaggccgtggggggtccctgagactctcctgtgcagcctctggtatttaccttcagtacttatggcatgaactgggtccgcaggctccgagggacgggctgcaggtggtttcactacattaatacgtaggaagtaggactaataactacacgagactcgtgtaggaacggccgtagttccacccacctccagacgacgaccgaccaagacctcactcgtctctcgacaagtacgaactacgacctaggaacgacggttacgaacgggtaccgaaccggtcgttacgttacggttaactttacggttcggtacggaccggaaggaacggtacggtacccggggaaggggtacgttagtaccggactacgttaaccggg

SEQ ID NO: 44464 - DNA, 717 bp, Homo sapiens
  misc_feature: GYAE6OF01CNW7E.7.85.H08.1.454.CMB.1.raw
  modified_base (576)..(576): a, c, t, g, unknown or other
  misc_feature (576)..(576): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggagcttggttcagccgtggggggtccctgagactctcctgtgcagcctctggtactttaccttcagtacttatggctatgaacgtcgggtccgccgaggcctaccggaggggaacgggctgcgtaggttcggttacactactaattaatacgtaggaagtacggaacctaattaaacttaacaacgacgtaaccttcgtaggtacggaaacggggtccctaagtttacccaaccctaaccccgttacccgaaagggaaacccggtaaccgaacccggaacccgtaaaacggtaaacccttacccgtaacccgtttcggttacccttaccgttacggaaacctaaaaagttccggaaaaaccncggtaaccccgttaagggaacgggttaacggttacccgggaagggtacccgtaccgggtacgtttacggttaggttacttacggtcggtagacggtaaggacggtacggtaccggggagggtaactagacgcgtagtacgg

SEQ ID NO: 44465 - DNA, 762 bp, Homo sapiens
  misc_feature: GYAE6OF01EJWTU.7.85.H08.1.454.CMB.1.raw
  modified_base (303)..(303): a, c, t, g, unknown or other
  misc_feature (303)..(303): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggagcgttggttcagccgtggggggtccctgagctctcctgtgcagcctctggatttaccttcagttacttatggcatgaactgggtccncgaggctccgagggagggctgctaggtcggttcacgactattaaatacgtagggtaaagtacggaccctaagttaaacttaaccaacgtacgacctttcgtaggttacggaacggggcccgtaatttacccgaaccccacccgtcccaaacggtaacgaacccggaacccgcccaaaacggaacccgttaccaacccgttcggttacccttaccgttacgggaacctaaaacgttaggaaacccaacgggtaccccgttagggaaacggtaccgggttacccgggaacgggtaacccgaccggggtaccgttacgggttacggttaaaccgttttacccgttagggggttacgaacccgggtaaaggggtaaccgggtaaacccggttccccgggggggtaaaacgggggggttaaccttaagggtacccggtaaacccgttaaggtttaaacccgggg

SEQ ID NO: 44466 - DNA, 739 bp, Homo sapiens
  misc_feature: GYAE6OF01EH2WW.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggaggttggggctgtgtcgttgggttttccttgttgcttattttagaaggtgtccaagtgtgaggtgcagcgtgggtggtagtcggtgggggagtcgttggttcgacggtccggtcgggggtccctggtacgcctctccgtgtcgcgtacgcctgtggtactttacctcgtagttacttagtcggtactagtacgtaacgtcgggtcccgacgtacggccgtaccggaggggacggtcgtgacgtggttacggttacaacgtaagtaacgttaacgtacgtaggtaacggtaacgacctaagttaactacacgtacgtaccgttgtaggtacggaaccggtaccgtaacttaccccgaaccgtaccgtacggaaggaccgtaaacccgtaacgaaccgtaaacgtaaccctaccgtacgttcgttcctacggtaagaaccctaaaggtacaaaccggtccgtacccggaggtaacggtccggttaacggacccggtaacgtcgggttcttagggtttaacgtacgtttaacggcggttaggaacggtacgggtaaggtacccggtagggggtaaccgtagttacgaccggtactagggttacccgg

SEQ ID NO: 44467 - DNA, 684 bp, Homo sapiens
  misc_feature: GYAE6OF01BXLLH.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatgggagttggggctgtgcttgggttttccttgttgcttattttagaaggtgtccaatgtgaggtgcagctggtggagtcgtgggggagcttggttcaggccgtggggggtccctgagactctcctgtcgcagcctctggtacttttacccttcagtacttatggctagtgaacgtcggggtcccgccgaggccgtaccgaggggaacggggctggcgtaggttgggttacactactaagttaactaacgtaggaaaggtacggaacctaagttaacttaacaacgtaacgaccttaccgtaggtacggaacggggtccattaccaccccaccgtaccgagaacgaaccgaacgaacccaaggaacctccgtaactcgtacctccgtagactaaagacgaacacggtacccaggtacggacgtcggaacgggtaacccacggggtcccttagggttagttaaaccgtttcggacggtacgtaagggacggaacggtacgggtacccggggtaagggggaaccgttagtaccggaaacccgttgttaacccggg

SEQ ID NO: 44468 - DNA, 573 bp, Homo sapiens
  misc_feature: GYAE6OF01BK1NK.7.85.H08.1.454.CMB.1.raw
  modified_base (567)..(567): a, c, t, g, unknown or other
  misc_feature (567)..(567): n is a, c, g, or t
tcagcgtgtctctacacgaccggtgctcgatttagtatcactcagtcgcggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcgttggttcagccgtggggggtcccctggacgactctcctgtcgcagcctctggactttaccttcagttacttagtggcatgaactgggtccgccgaggctccgagggagggctgcgagtggtttcacacattaatacgtggaacgtaggaccaataacttaacactagacttcgtgtacggaacgggccgtattccaacccaccctccgaaggtacacggacgaccaaacgaactcacttgtacctcgtcgactaaagtcgaacagtaccgtaggtacgacgttcgaggacacggcttgtcgtagttacgtgtgacgagagacgtaccgggagggtacgtagtcgacgngtacgg

SEQ ID NO: 44469 - DNA, 789 bp, Homo sapiens
  misc_feature: GYAE6OF01DJ2AZ.7.85.H08.1.454.CMB.1.raw
  modified_base (777)..(777): a, c, t, g, unknown or other
  misc_feature (777)..(777): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagcgtggtggagtcgtgggggaggtctttggttcagtccggtcggggggtcccctggacgtacctctccgtgtgcacgtccttcgtaggtaacttttacccgtttcaagttaccttaagtcggactagttacggtaaaccgttcggggttacccggcccggtacggtcccggtacccggggaagggggtaacggggtcgtacggtaccggttagggtttccgggttaaccaaccgttaaacgttaagtttaaacgtaacgggtaagggtaaaacggttaacggtaaacccttaaaacgtttaaacccttaaccgaacgtacgttaccgttacggttacggtaaaggggaacccgggttaccttaaccgttacccaacccccgtaaccctacggaaacggacccgaaccggtaacccgaaacaacgtacctacctacgtcgttactcgtaacgaactaaacgtacaaacgtcgtaaccgtagacggtaacggtacgtaacggaccgtacggtacgttgttacgttactacggtgacggacggtaagtacggtacgggtacggggtacggttagtcgtaaccncgtagttaccgg

SEQ ID NO: 44470 - DNA, 645 bp, Homo sapiens
  misc_feature: GYAE6OF01CGLZI.7.85.H08.1.454.CMB.1.raw
  modified_base (538)..(538): a, c, t, g, unknown or other
  misc_feature (538)..(538): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggtttccttgttgcttattttagaggtgtccaatgtgaggtgcagcgtgggtggaggtcggtgggggaggtcgtttgggttcgacggtccggttcgggggggtccctggacgtaccgtctccgtgtcgcacgccctcgtggtactttaccttctagtacttagtggcagtcgtaacgtcggtcccgccgaggcctaccggaggggacggtcgtggacgtaggttcgggttaccacgtactaagtttaaagtaccgtagggaaacgtacgaacctaataaacttacaactacgtactcgtggtaggacgggtaccacttaccaccacctacgagacgaacgaccgtaaccaagtacctacacgttcgtcctagacataacacgaacncgactagggtaacacggtacgacgggacctacgggcttaggtacgttatacggtcggtgacggacgagtacggtacgggaacgggtactagccgacgtgttaccggg

SEQ ID NO: 44471 - DNA, 914 bp, Homo sapiens
  misc_feature: GYAE6OF01C7UD8.7.85.H08.1.454.CMB.1.raw
tcagcgtgtctctacacgaccggtgctcgatttagtatcactcagtcgcgggggctctcagagaggtgccttagccctggattccaaggctatttccacttggtgatcagcactgaacacagaggactcaccagtggaggttgggctgtgtcgttgggttttccttgttgtcttattttaaggaaggtgtaccaagtggtggaggtgcgaggtcgtgggtgggtaggttcggtggggggagtcgtttcggttcgacgggtcccggttcggggggtccctggaacgtccgttccttccgttggtcgaccgtcggtcccttcgtagggtttaaccttttaccgttacgtaacgtttaaccgtttagtcggtactaaggtacgtaacggtccgggtacccgcggtaacggtccggtacccgggaagggggtacggtacgtggtacggtggtttacgggtttaccaacgtaacttaacgtttaacgtaacggtaacgggtaaaacgtaaccggtaaccttaaaacgttaaacctttaaccgaacccgttaacggtacccgtttacggttaggttaaaccggggaaccgggttacccgttaaccgttaaccccaacccggttaacccctacggaaacgggaacgaaacccggaacccgtaaccgtaaacgaaccccgttcgtaactttccggacccgttacgttaaagaacctaaagtaacccggtaacgaccgtaccggttaacgggacggttaaccgggtaacgggaaccggtaccggtaaaccggtttcgttacgttaaacgtttacggttaaccgtcgggttaagggaacggttaacggaacggggttaacccgggtacgggggtaacggtttaaaccgtcggtaaaccggaacccggtttaggttaaccccggg

SEQ ID NO: 44472 - DNA, 617 bp, Homo sapiens
  misc_feature: GYAE6OF01BDJ4Z.7.85.H08.1.454.CMB.1.raw
  modified_base (259)..(259): a, c, t, g, unknown or other
  misc_feature (259)..(259): n is a, c, g, or t
  modified_base (492)..(492): a, c, t, g, unknown or other
  misc_feature (492)..(492): n is a, c, g, or t
tcagcgtgtctctacacgaccggtgctcgatttagtatcactcagtcgcgggggctctcagagaggtgccttagccctggattccaaggcatttccacttggtgatcagcactgaacatagaggactcaccatggagttggggctgtgcttgggtttccttgttgctattttagaaggtgtccaatgtgaggtgcagctggtggagtcgtgggggaggcttggttcacgccgtggggggtccctggagactctcctgtncagcctcgtggtactttaccttcagtacttatggcatgaactggtccgccaggctcgagggagggctgcgaggtggttacacgtacattaactacgtagggaaagtacggacctaattaaaccttaacaactacgtacttaccgtgtaggaacgggccctaatacccgaccacctccgaggacgaaccgacgacccaaagactcctactcgtctctagactaaagtcgaaacngccctaggagtacggtacgaacggacgtaaccgcgttacgtagtttaacgttacgtcgtaggcggaaacggtagtacgggtacccggggaggggtaaccgtagaccgtaacgtagttaacccggg

SEQ ID NO: 44473 - DNA, 688 bp, Homo sapiens
  misc_feature: GYAE6OF01C6P2I.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgtcttgggttttccttgttgcttattttagaaggtgtccaatgtgaggtgcagctgggtggagtcgtgggggaggtcttggttcagccgtggggggtccctgagactctccgtgtgcagtcctcgtggtactttaccttcagttactatggcatgaacgtggtccgccaggctccgaggggagggctgcgagttgggttacacactaattaactacgtaggtaaagtacggaaccaagttaacttacaacagtacctacgttaggtaggaaacgggtccgaactttacccgaacccgtaaccccttaccgaaggtaaccggaccgtaaaccgaccaaacggtaaccttaccaaccgttcggtcttaccgttaacggaactaaaacgtacgaaacctaacggtacccgttaagaaggaacggtttaccggaaggtacccgtaccgggtacttacgtacgtttaacgtacgttggtagaccggaaggtacggtacggttacccggggaagggttaacgtagtaacggaccgtaagttaccggg

SEQ ID NO: 44474 - DNA, 678 bp, Homo sapiens
  misc_feature: GYAE6OF01CBI6G.7.85.H08.1.454.CMB.1.raw
  modified_base (199)..(199): a, c, t, g, unknown or other
  misc_feature (199)..(199): n is a, c, g, or t
  modified_base (565)..(565): a, c, t, g, unknown or other
  misc_feature (565)..(565): n is a, c, g, or t
  modified_base (659)..(659): a, c, t, g, unknown or other
  misc_feature (659)..(659): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccagtggagttgggctgtgtcgttgggttttccttgttgcttattttagaaggtgtcaatgtgaggtgcngcgtggtggagtcgtgggggagtcgttggttcaggtccggtcggggggtccctgacgacctcctccgtgtagccacgtccttcgttggtaacttttaccttacgtagttactttagtcggactagtacgtaaccggtcgggtcccgaccgtacggccgtaccggaggggaacgggctacggcggtaggtttcggttaccaagtactaattaacgtgtaggtaaagtacgacctaagtaactacaatacgtactcgtagtaggaacggtcctaacgttccaacccgaccgtacgaaaggtaccgaaccgtaaccgaccctaaagtaccctacgtaactcgtaccttcgagaaacctagtacgaaccncggtaccgtagaacgtacgtacggacgacgtagccgttagtcttaagtacgtggtacggacagggttaccgtacgggacgggtacggactttancggtaaccgtgttaccggg

SEQ ID NO: 44475 - DNA, 742 bp, Homo sapiens
  misc_feature: GYAE6OF01CA3L3.7.85.H08.1.454.CMB.1.raw
  modified_base (672)..(672): a, c, t, g, unknown or other
  misc_feature (672)..(672): n is a, c, g, or t
  modified_base (688)..(688): a, c, t, g, unknown or other
  misc_feature (688)..(688): n is a, c, g, or t
  modified_base (735)..(735): a, c, t, g, unknown or other
  misc_feature (735)..(735): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgtcttgggttttccttgttgcttattttagaaggtgtaccaatgtgaggtgcagcgtggtggagtcggtgggggaggtcgtttgggttcgacggtccggttcggggggtccctggacgtaccttccgttccgtggtcgccgacggtcccttcgttaggttaactttttacccgttacgtaagtttacctttagtcggtctacgttacggtaaaccgttccggggtaccccgccgaacgggtcccgtaccgggaacgggggtaagggccttaggcggttacgggttttcgggttaccaactaaccgtaagtttaaacgtacggtagggtaaacggttacggaaccctaagttaaaccgtacaacgaacgtaccgttacgtggtacggaacgggtcctaacgttacccaacccgtaccctacgaagtaaccgaccgtaaccgaacctaaagtacctacctaacgttcgtacctacgtagaaacctaagtacgaacctgtccgtagacgtacggcgaacggacacggtnttgtacgttagttcgnggtagacggtagacggtacgtaccggggaggttactagtacaccgtntaccggg

SEQ ID NO: 44476 - DNA, 560 bp, Homo sapiens
  misc_feature: GYAE6OF01AD4GW.7.85.H08.1.454.CMB.1.raw
  modified_base (446)..(446): a, c, t, g, unknown or other
  misc_feature (446)..(446): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggtactttaccttcagtacttatggctatgaacgtgggtccgcaggcctccgaggggagggctgcgaggttgggtttcacactattaactacgtaggaagtaggacctaataacttacacagactctgtgaggccgtattccaccacctcagacgaccgacgaccaagactcactgtctcngacaaagtcgaacagcctaggacgtacgtcggaacggacacggtctggtacgtacttacgtggtacgcggagacggtagtaccgggggaagggtactagcgaccgtgtaccggg

SEQ ID NO: 44477 - DNA, 715 bp, Homo sapiens
  misc_feature: GYAE6OF01AXIVP.7.85.H08.1.454.CMB.1.raw
  modified_base (304)..(304): a, c, t, g, unknown or other
  misc_feature (304)..(304): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggagcttggttcagccgtgggggtccctgagactctcctgtgcagcctctggattttaccttcagttacttatggcatgaactgggtcccnccgaggctccgaggggaacgggctggcgagttcgggtttcaacgactatttaatacgtcggaagtacgggaacctactaaacgttacacaagtactccgtggtacggaaccgggggtcctaactttccgaaccctaccgttacccaaacgggtacggaacccgaccgaccctaaaaggaccttaccctaacgttgtaccctcgtacgaactaaagtcggaaccacgtcccgtaggaacggtacgttacgggaacggtaccgtaaccggggtccgttaggttacggttaaccgtttaacgtcggggtttacgaaacccgggtaggttaaacccggggtacggttaacccgggggggtaacggggtaaaccggtttaaacgttccgggaaaaccccgttggttaaacccgggg

SEQ ID NO: 44478 - DNA, 682 bp, Homo sapiens
  misc_feature: GYAE6OF01C4XCA.7.85.H08.1.454.CMB.1.raw
  modified_base (243)..(243): a, c, t, g, unknown or other
  misc_feature (243)..(243): n is a, c, g, or t
  modified_base (528)..(528): a, c, t, g, unknown or other
  misc_feature (528)..(528): n is a, c, g, or t
tcagcgtgtctctacacgaccggtgctcgatttagtatcactcagtcgcggggctctcagagagtgccttagccctggattccaaggcatttccacttggtgatcagcactgaacacagaggactcacatggagttgggctgtgcgttgggttttccttgttgtcttattttagaaggtgtccaatgtgaggtgcagctggtggagtcgtggggagtcgttggttcaggccgtcgggggtccngacgctctctgtcgcacgtcctgtggtacttttaccttcagttaccttagtcggactagtacgaacggttccgggtcccgcgtacggccctaccggaaggggtacgggtctcggtacgtagggtttcggttaccaacgtaacgttaatttaacgtacgttaagggaacgtacgtaacaacgttaacttacaacgtacgtacttcgtaggtacggaacgggtcctaacttccgaaccctaccgtacgagaacgaccgaccgacaagaacctcgatcgtctacgtanaactaaagcaaaccgtgcccgtaggaacggtacgtacggaacggtacgaccgggtcttaggtaacgttaacgtcgttacggaggtaaccggaggtaccgggtaacgggtcccgggtaaacggggtctaaggtccggaaacgttcgttaaccggg

SEQ ID NO: 44479 - DNA, 621 bp, Homo sapiens
  misc_feature: GYAE6OF01DTT65.7.85.H08.1.454.CMB.1.raw
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagctggtggagtcgtgggggagtcttggttcagccgtgggggtccctgagactctcctgtgcagcctcgtggtacttttaccttacagttacttagtggacattggaacgtcgggtcccgcgacggctaccggaggggaacgggctgcgtaggttgggttacacactattaactacgtaggaacgtacggaacctaagttaaactacacacgtactctggtacggaacgggtcctattaccaccctacctcgaagacgacgaaccgacaacgactcactgtctcanactaatcgaacngtccgtagacgtagtcggaacggtaccgacggtctggttagttaacttacggtcggtaggacggtaaggacgggtaaccggtaccgggggtagggtaaaccgttagtaccggtacctaggtacccgg

SEQ ID NO: 44480 - DNA, 585 bp, Homo sapiens
  misc_feature: GYAE6OF01A9MRP.7.85.H08.1.454.CMB.1.raw
  modified_base (484)..(484): a, c, t, g, unknown or other
  misc_feature (484)..(484): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaagtgtccaatgtgagtgcagctggtggagtcgtgggggaggtctttggttcagccgtgggggtccctgacgctctcctgtcgctacgccttcgtggtattttacccttcagttacttatggcagtcgtaacgtcgggtcccgccgaggtcctccgaaggggtacgggctggcaggttcgggttacaactactattaaagtacgtaggtaagtacgacctaattaaccttacactagtactacgtggtaggaacgggcctattaccaccctaccgacagacgacacgaccaaagactcacttcgtcctnacgacaatcgaactcgctagacgagtacgacgactcggcgttagtagttagttcgnggtnacggagacggtcgaacgggtacgggtactagcgagtgtacg

SEQ ID NO: 44481 - DNA, 743 bp, Homo sapiens
  misc_feature: GYAE6OF01BGY21.7.85.H08.1.454.CMB.1.raw
  modified_base (191)..(191): a, c, t, g, unknown or other
  misc_feature (191)..(191): n is a, c, g, or t
  modified_base (585)..(585): a, c, t, g, unknown or other
  misc_feature (585)..(585): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggaggttgggcttgttcgttggtttttccttgttgtcttatttagaggtgtcatgtgnggtgcagcgtgggtggaggtcggtgggggtaggtcgttggttcgacggtccggttcgggggtccctaggacgtctccgtccgtgtcgcgacgtccttcgttcggttaccttttaccttacgttacgttacgttagtcgtactacgtacggtaaccggttccgggtcccgacccgtacgggtacccgtaccgggaagggggtaaccggggtcgtacggtacggtagggtttcgggttacaacgtaacttaagttaaacgtacggtaacggtaaaggtaacggtaacctaacttaactacgaactacgtacttcgtaggtaggaccggtactactaccacccactacgaagacgacgaccaacaacgtctcagttctactacctagaacttaacgngaacgtcgcgtaggacgtacggtaccggacggtacgtacgtgttagttacgtttacttaacgggtggaacgtggaaacggtacgggtaacccggggttacggggaacgggttaacaaccggtttaaccgacggtttaccggttcccgggttaaccggg

SEQ ID NO: 44482 - DNA, 787 bp, Homo sapiens
  misc_feature: GYAE6OF01DE09H.7.85.H08.1.454.CMB.1.raw
tcagcgtgtctctacacgaccggtgctcgatttagtatcactcagtcgcgggggctctcagagaggtgccttagccctggattccaaggcattccacttggtgatcagcactgaacacagagactcacatggagttgggctgtgcgttggtttccttgttgcttatttagagtgtctatgtgaggtgcgagtcgtggtggtaggtcggtggggtaggtcgtttgggttcgacggtccggttcggggggtcccgtggtacgtcctccgtccgtggtacgcgacgtccgttcgtacggttactttaccttacgtagttacttagtcggactagtacggtaaccggttcgggtacccgaccggacggtacccgtaccggggaagggggtacgggtcggtcgtaccggtagggtttacggttacctaaccgtaattaacgtttaaacgtaccggtaagggtaacggtaaccggtaacctaaaagttaaccctaacgaaccgtagtaccgttgtacggtagggaaccgggtaccgtactaacccgtaccctaacccgtaaccggaacggaacgtaacccggaaccgtaaaccgtaaaaccgtacctaccgtacgttacgttactaccgttacggaactaaacgaacgtaacgtaccgtacgtagtaacgtaggaccgaggtaaccggcgtcgttaggttaacttacgttaacggttggtaaggacggtaaggggaaccgtacgggtaaccggggaacggtaacgttacgacggttaaaccgtgttacccggg

SEQ ID NO: 44483 - DNA, 776 bp, Homo sapiens
  misc_feature: GYAE6OF01A77PY.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcttgggttttccttgttgcttattttagaaggtgtccaatgtgaggtgcagtcgtggtggagtcgtgggggaggtcgttggttcagccggtgggggtccctgacgactctcctgtgcacgtcctcgtggtacttttaccttctaagttacttagtcggaccagttcggtaaccgtcggggtccccgaccgaacgggtcctaccggaaggggaacgggctcgacggtaggttcggtttacaactaacgttagttaaactacgtaagggtaaagtacggaacctaaattaaaccgttaacaacgtaacgacttcgtaggtacggtaacgggtccgtaacttacccgaacccgtacccgtacgaaggaacccggtaaccgaaccgtaacccgaaaacgtaaccttacccgtacgttcgtacctaccgtagaaccgttaaacgacgaaacctggtaccctagggtaaaccgggtacggttaaccgggaacgggaaccgtaccgggtcctttaaggttacgtttaaaccgttacggttcggtacgggaacccggtaaggtaacgggttacccgggtaaccggggggtaacggtacccggttaaaggtccccgtaaacgggtacggtttaccggg

SEQ ID NO: 44484 - DNA, 712 bp, Homo sapiens
  misc_feature: GYAE6OF01A219C.7.85.H08.1.454.CMB.1.raw
  modified_base (632)..(632): a, c, t, g, unknown or other
  misc_feature (632)..(632): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctatttagaaggtgtccaatgtgaggtgcagctggtggagtcgtgggggaggtcgttggttcagtccggtggggggtcccctggagacctctccgtggtcgcacgcctcgtggtacttttacccttactagttaccttaagtcggacagttgtaaccgttcggggtcccgccggaggtccgtacccggaagggggaacggggtctggtccgtagggttcgggtttacaactactaagttaaagtacgtaggaacgtacggaacctaataacctacgacagtactcgtaggtaggaacggtcctacttaccgaccctaccgtaccaacggtacgaaccgaccgtaaccaaacggtacctacgaccgtgttacctcgtaacgactaaacgtacgaaaccgacgtaccgtaaggacgtacggaacggtaaccggaccgtacggtccgttagttacgttaacgtttacggnggttacggaacggagggtaaccgggtaaccggttaccgggggaacgggtaacgttaacggacgtaccgtgttaacccggg

SEQ ID NO: 44485 - DNA, 616 bp, Homo sapiens
  misc_feature: GYAE6OF01A4V4S.7.85.H08.1.454.CMB.1.raw
  modified_base (273)..(273): a, c, t, g, unknown or other
  misc_feature (273)..(273): n is a, c, g, or t
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (478)..(478): a, c, t, g, unknown or other
  misc_feature (478)..(478): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagctggtggagtcgtgggggaggtcttggttcaggtcccgtgggggggtcccctggagtactctcctgtgcagcctntggactttaccttcagttacttatggctatcgaacgtcggggtccnccgaggctcgaggggacgggctgctaggtggttacacgactattaatacgtaggaagtacggacctaagtaaccttacacagtactntggtaggaacgggtccattcccaacccacctccgagacgaccgaccaccaaagtacctcaaccttgtctcgngaacaaactgaaccacgacctgacgtaggtcgacggacctcgggcttggtacgttaagttacgtggtcggaacggtaagaacgggtcggtaacccgggggtagggtaaaccgttgtacccgtaacgtcgttaccgggg

SEQ ID NO: 44486 - DNA, 787 bp, Homo sapiens
  misc_feature: GYAE6OF01EDZ7Z.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttcctgttgctattttagaaggtgtccaatgtgaggtgcagctggtggagtcgtgggggaggcttggttcacggccgtggggggtccctgacgctctcctgtgcagcctcgtggtactttacctcagttaccttagtggcagttcgaacgtcggggtcccgccgaggtcgtccggaggggaacggggtcctggacgtaggttcgggtttacaaccgtaacgtaagttaaacgtacgtaagggtaaacggttaacggaaccctaagttaaaccttaaccacgtaaacgtaccgttacggtaggttacgggaacgggtacccgtacttaccaaccctacccgtaccgaacggtaacgtaaacccggaaccgaacccgtaaaacgtaacccttaccgtaaccgtttaccgtaccgttaccgaaggttaacccaaaaagtttccggaaaaccgacggttaccccgtaggtaaaccggtaagggttacccgggacggtaaccgggtaaccggtacgttagggtttacggttaaacgtttacccggttagggtaacggtacggtaacggtaacgggtaaacccgggtaccgggggaaggggttaaccgtagtacccggtaaccgtagttaacccggg

SEQ ID NO: 44487 - DNA, 653 bp, Homo sapiens
  misc_feature: GYAE6OF01DTJ7Z.7.85.H08.1.454.CMB.1.raw
  modified_base (398)..(398): a, c, t, g, unknown or other
  misc_feature (398)..(398): n is a, c, g, or t
  modified_base (519)..(519): a, c, t, g, unknown or other
  misc_feature (519)..(519): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaagtgtccaatgtgaggtgcagctggtggagtcgtgggggaggcttggttcagccgtgggggtccctgagtacctctccgtgtgcacgccttctggtacttttaacccttcagttaccttagtaggacattacggaaccgttcggggtcccgaccgaaggtcctaccggaagggggtaacggggtctagactaagggttcgggttaccacgtaacaatttaanacttagggaagtacggaactaataaacttacgacagactctaggtacggaagggcctaattccaccacctcaagagaaccgacaaccaagactcacttcgtctctagactaaagtgaaacngcctagaaggtagacggaacgggacacggtcctaggtcgttaaattacgtgggtacgtcggaaaaaggtacggtacggtaaccccgggggtaggggtaaacgttacgtaaacggtacccgtaaggttaacccgg

SEQ ID NO: 44488 - DNA, 868 bp, Homo sapiens
  misc_feature: GYAE6OF01BJPAB.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagaggactcaccatggagttggggctgtcgtccggttttccttgttgcttagtttagaaggtgtccaagtgtgaggtgcgagcgtggtggagtcgtggggagtcgttggttcgagtccggttcgggggtccctggacgtaccgttcgtccgtggtcgccgacgtcccgttacgttacgggttaaccttttaacccgttaccgtaacgtttacgttagtcggtacgtaagttacggtaaaccggttccggggtccccggtaccgtaaccgggtcccgttacccgggaacgggggtaacgggggtccgttacgggtaccgtaacgggttttacggggtttacccaaaccgtaacgttaaacgtttaaacgtaaccggtaagggtaaacggtaaacggtaacctaaacgttaaactttaaccaaccgtaacgttaccgttacgttggtaaacgggtaacgggtaccgttaacttacccgaacccctaacccgtaccggacgaaaccgtaacccggaaaccgacccgtaaaacgtaaccctacgtaccgtacgtacctcgttaacgaacgtaaacgttaacgaaccgtacggttaccgttagggaacggttaacggttaaccgggaccggtaaaccgaggttacgttacgggttagttacgtttacggtggtacgggtagtaacgggacggttaaccgggtacgggaacgggttacctaacggtaccgtaaccggtgttccggttaacccgg

SEQ ID NO: 44489 - DNA, 786 bp, Homo sapiens
  misc_feature: GYAE6OF01ANTMB.7.85.H08.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (491)..(491): a, c, t, g, unknown or other
  misc_feature (491)..(491): n is a, c, g, or t
tcagcgtgtctctacacgaccggtgctcgatttagtatcactcagtcgcggggcgtctcagagaggtgccgttagacctggattccaaggcatttccacttggtgatcagcactgaacacagaggactcaccactggagttgggctgtgcgttggttttccttgttgtcttattttaggtaaggtgtccaattgtgaggtgcagctggnggagttcggngggggaggtcgttggttcgaggtcccggttcgggggggtcccttggagtaccttccgtccgtggtcgtcacgtcctcgttcgtagtttaccttcttacgttacttagttcggcgtaagtcgtaacgtcgggtcccgccgtacggtcccggtaccggaaggggtaacggggtcgtcggtacggtaggttcgggttacgtaactacgtaagttaactacggttaaggtaaacggtaacggtaaccgtaacgttaaaccgttaacgacccgtaanaccgttcgtacggttacggaacgggtaccgtacgttaccgacccgtacccgaccgtaggaacgtaccgaaccgggaacccaacggtaaccgtacctaacgttccgtaacgtccgtacgtaacgtaaacgacggtaacccgtacgtccggtaaacgtaggtaaccgggtacgaacgggtacccggaaacgttcggttacggttaacgttaacgtttacggtggttacgggacggtaaggttacggacccggtacgggtacggggaaccgtttaggaacgtacccgggtggttacgg

SEQ ID NO: 44490 - DNA, 736 bp, Homo sapiens
  misc_feature: GYAE6OF01BBSLA.7.85.H08.1.454.CMB.1.raw
tcagcgtgtctctacacgaccggtgctcgatttagtatcactcagtcgcgggggctctcagagaggtcgccttagccctggattccaaggcatttccacttggtgatcagcactgaacacagaggactcaccatggagttggggctgtgcttgggtttcctgttgctattttagaggtgtcaatgtgaggtgcagcgtggtggagtcggtgggggagtcgttggttcgagccggtcggggggtccctggacgtactctccgtgtcgcacgtcctcgtaggtacttttaccttgtaagttacttagtcggtactagttcgtaaacggtcggggtcccgcccggacggtcccgttaccggggaaggggtaacgggggtcctggacgtagggttggggtttaccaacgtaactaagttaaacgtacggtaggtaaacggttacggaacctaaacgtaaacttacaacgtaacgtactacgtaggtacggaacgggtccgtaacttacccgaaccctacccgtacgtaaggacgaaccgaccgaaccgaaacgtaccgtactaaccgttcggtacctacgtacgaactaaagtacgaaccacgtaccgtagaacggtagtacggaacggtacgacggtacgttgtacgtttaaactccggtagggtacgaacgggtaagacgggtaacggtaaccgggggtaggttaacgggttacgaacggtaacctaggttaacccgg

SEQ ID NO: 44491 - DNA, 738 bp, Homo sapiens
  misc_feature: GYAE6OF01CWPPP.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggagtcgtgggggagtcgttggttcaggtccgtggggggtccctgagctctccgtgtgcacgtcctctggtaacttttaccttactaagttacttagtggacctagtgaacgtcgggtccgccgaggcctaccggaaggggaagggctggacgtagttcgggtttacaacgtactaatttaacgtacgtagggtaaacggtaaggtaaccctaaagttaaaccttaacgaaccgtaacgtaaccttacgttaggtaacggtaaccgggtccgtaactttaccccgaacccgtaaccccgtaccgaaaggaccggaaccgaaccgtaaacccgaaacgtaaccgtacctaaccgttcggtacctaccgtaacgaccttaaaagtcggtaaaccaacggtacccggttaggtaaccggtaacgttaccgggaacggtacccggaaccggtaccgttaggttacgttaacgttacgtggacggtacggaaagacggtacggtaccggggagggaaccttagtacgacgtgttaacgg

SEQ ID NO: 44492 - DNA, 602 bp, Homo sapiens
  misc_feature: GYAE6OF01BI6YB.7.85.H08.1.454.CMB.1.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (449)..(449): a, c, t, g, unknown or other
  misc_feature (449)..(449): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggatttacccttnagtacttatggcatgaacgtgggtccncaggctccgagggagggctgcaggtggttcacactattaatacgtggaagtaggaccaattaacttacacagactctgtagaacgggcctaattccaacccaccttccgaaggacgaccgacgacccaaagacctcactgtctntagacaaatgaacagcctaggacgtacgtcggaaggacaccggtcttggttacgttaacttacgtgggttacgacgggtaagtaacggtaaccggttaccccggggggtaaagggggtaaccttaaggaccggtaacccgtaggttacccggg

SEQ ID NO: 44493 - DNA, 997 bp, Homo sapiens
  misc_feature: GYAE6OF01A2RTG.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagcgtggtggagtcgtgggggaggtcgtttggttcgacggtcccggttcgggggggttcccctggacgtaccttccgttcccgttggtcgccgacgtcccttcgttacggtaacttttaccctttaccgtaagttaacctttagtcgggtacctaagttacggtaaaccggttccggggttaccccgacccggtaccgggtacccgttacccgggaaaggggggtaacgggggtccgttcggtaccggttagggtttaccggggttttaccaaaccgtaacgttaaacgttttaaacgttaaccggttaaggggtaaacggttaaccggaaaccctaaacgtttaaaacccgtttaaccgaaaccgtaacggtaaacccgtttacggttaacgggttaacgggtaaaccgggggtaccccttaaacgttttacccccgaaaccccccgttaaccccgtaaccccggaaaacgggtaaacccggaaaccccgggtaaacccggtaaaccccgtaaaaacggtaacccccgtttacccgtaaacccggttttcggttaaccccgttaccgttaaacggtaaacccttaaaaacgttacccgggaaaaacctacccgggttaacccggtttaagggaaaccgggttaacgggttaacccgggaaacgggtaccgtaaccgggtacgtttaaggttaccgttaaacgtttacggtcgggtacggaaccgggtaaggaaccgggttaacgggtacccgggggtaaggggtaaccttaggtacccggaaacgttaggtaacccggg

SEQ ID NO: 44494 - DNA, 565 bp, Homo sapiens
  misc_feature: GYAE6OF01EWSGI.7.85.H08.1.454.CMB.1.raw
  modified_base (501)..(501): a, c, t, g, unknown or other
  misc_feature (501)..(501): n is a, c, g, or t
  modified_base (559)..(559): a, c, t, g, unknown or other
  misc_feature (559)..(559): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgcttgggttttccttgttgctattttagaggtgtccaatgtgaggtgcagctggtggagtcgtggggggaggtcttggttcagtccgtggggggtccctggagacctctcctgtgcagcctctggatttaccttcagtacttatggcatgaactggggtcccgccgaggctccgagggagggctgcagtgggttcacactattaatacgtgaagtacggactataactacacagactctgtagaggaccgattaccaccacctcagacgacgaccgaccaagactcacttgtactcctagacaagtagaaccaggtcccagtacggagtaccggaggacctacgggcttaggtnttacttacgtggtggacggagaggacgtcccggggaggggttaactaaggtcgaaccngtacgg

SEQ ID NO: 44495 - DNA, 779 bp, Homo sapiens
  misc_feature: GYAE6OF01DGYU3.7.85.H08.1.454.CMB.1.raw
  modified_base (167)..(167): a, c, t, g, unknown or other
  misc_feature (167)..(167): n is a, c, g, or t
  modified_base (183)..(183): a, c, t, g, unknown or other
  misc_feature (183)..(183): n is a, c, g, or t
  modified_base (601)..(601): a, c, t, g, unknown or other
  misc_feature (601)..(601): n is a, c, g, or t
tcagcgtgtctctacacgaccggtgctcgatttagtatcactcagtcgcgggggctctcagagaggtgccttagacctggattccaaggctatttccacttggtgatcagcactgaacacagaggactcaccatggagttgggctgtgcgttgggttttccttgttntcttattttagaggtntcaatgtggagtgcgagcgtgggtggagtcggtgggggagtcgtttggttacgacggtccgggtcggggggtccctgacgtccttccgtccgtgtcgactacgtccgttcgttacggttaccttttaccttacgtaagttaacttgttggactaagttacggtaccggttcgggtcccgaccggacggtccggtacgggaacgggggtacggtctacggtacggtacgggtttccggttaccaacgtactaattaaacgtacggtaaggaagtacgtaactaaacgttaaactacgaactagtaccgttaggtaggtacggaccgggtaacctacttacccgaaccctacccgtacgaacggaaccgtaaccaacgtaccaaacgtacctccgtacgttactacgtactaccgtaaanacgtaaccgaactacgtacggtagtaaccgtacggtacggaaaccgggtcaaccggtagtttagtacggttttaacgcggtttacggaacgggtacggaaaggttaacgggtacccggggttacggggaaacggggttttacaaccggtaacgtttaaccccggagtttaccccgggg

SEQ ID NO: 44496 - DNA, 874 bp, Homo sapiens
  misc_feature: GYAE6OF01AOME3.7.85.H08.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccagtggagttgggctgtgcgttgggttttccttgttcgcttagttttagaaggtgtccaatgtgaggtgcagcgtgggtggtagtcggtggggagtcgttggtcgacgtccggtcgggggtcctggacgtcgtctcgtgtcncgacgtcctgtgtactttactcgtagttacgttntcggactagtacgtaccgtcggtaccgaccgacggtccgtacgggaagggggtaccgggtcgtacgggtacgtacgggtttacggttaccgaaactacgttaaacgttaaacgtacggtaacggggtaacggtaaccggtaaaccttaaacgtttaaccgtaacctacgtaaacggttacccgttacggtaggttaacgggaacccggggtaacccttaacgttacccgaaccccgttaaccgttacccgaaaggggaaaccccgtaaccgggaaccccgtaaaccgtaaaaccggttacccgtaaacccgttccgtttaaacgtccgttaaccgtaaacgggtaactaaaccgggtaaacgtacccgtaccgggtccttaaggggtaaaccgttaacgggtacccgggaaaccgtccggaacccgggtttagttacgtttaccgggttaaacttccggggttagaacccgggtaaccgggaaaggtaccgggtaacccgggttacccgggggggtaaacggtttacccgaagttaacccccggttaaaggtggtttaaccccggggg

SEQ ID NO: 44497 - DNA, 648 bp, Homo sapiens
  misc_feature: GYAE6OF01DQQIH.7.85.H08.1.454.CMB.1.raw
  modified_base (190)..(190): a, c, t, g, unknown or other
  misc_feature (190)..(190): n is a, c, g, or t
  modified_base (295)..(295): a, c, t, g, unknown or other
  misc_feature (295)..(295): n is a, c, g, or t
tcagcgtgtctctacacgaccggtgctcgatttagtatcactcagtcgcggggctctcagagaggtgccttagccctggattccaaggcatttccacttggtgatcagcactgaacacagagactcaccagtggagttgggctgtgcttggttttccttgttgcttattttagaagtgtcaatgtgagtncagcgtggtgagtcgtggggagtcgttggtcgacgtccggtgggggtccctgacgtacctctccgtgtcgcacgtcctcgtgtactttacctcgaagttactagnggctagtacgtaacgtcggtccgacgacggcctacggagggaggtctagcgtaggttcggttacacgtaactaagttaagtacgtaggaaagtaacgactaaataactacgaacacgtactgtagtacggaacggtctaacttaccaaccctacctacgaagacgaaccgaaccgaaccaacgtacctcctaacgttcgtactactagaactaaagcgaaactcgaacctaggaacgtacgtacgtaacggactacgggtcttaggtacgttaattacgtacggaggaccaaagggtaaccgtccggggtaacgggtacggggttaacttacgacccgaagttggtaacccgg

SEQ ID NO: 44498 - DNA, 745 bp, Homo sapiens
  misc_feature: GYAE6OF01A0BQX.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgcttattttagaaggtgtccaatgtgaggtgcagctgggtggagtcgtggggggagtcttgggttcaggtccggtggggggtccctgagacttctcctgtcgcacgccttcgtggtactttaccttctagttacttatggtactagtaggtaaccgttcggggtacccgccgtacggtccgtaccggaagggggaacggggtctggacgttagggtttcgggtttaccaacgtaactaatttaaactacgtagggtaaacgtaacggaacctaagttaaaccttacgaactagacctcgtagggtacggtaacgggccgttactaccacccacccgtaccgaggaaccgaaccgaccgaaccaaacgtaacctccgacgttcgtctacgtagacaaacgtcgaactacggtacctagggtaggaaccggttacgggacggtaacccgtacggggtccttaggttacggtttaacctttacggtacggttacgggaccggtaaaggtaccgggtaaccgggtttacccgggggggaaacgggtaccggttaaacgtcccgggtaaacttgggttaaccccggg

SEQ ID NO: 44499 - DNA, 799 bp, Homo sapiens
  misc_feature: GYAE6OF01BH3JQ.7.85.H08.1.454.CMB.1.raw
  modified_base (215)..(215): a, c, t, g, unknown or other
  misc_feature (215)..(215): n is a, c, g, or t
  modified_base (726)..(726): a, c, t, g, unknown or other
  misc_feature (726)..(726): n is a, c, g, or t
tcagcgtgtctctacacgaccggtgctcgatttagtatcactcagtcgcggggctctcagagaggtgccttagacctggattccaaggcatttccacttggtgatcagcactgaacacagaggactcaccatggagttgggctgtgcgttgggtttcttgttgcttatttagaaggtgtcaatgtgaggtgcagcgtggtggagtcggtgggggngtcgttggtcgacgtccggtgggggtccctgagtaccttcctcgtgtcgcacgtcctgttcggtaactttaccgttcgtaagttacttacgtggtactagtacgtaacggttcgggtcccgaccgacggtccgtaccgggaaggggtacggggtcgtcggtacggtacggtttcggggttaccaacgtaacgttaactttaaacggtacggttaaagggaaacggttaaccggtaacctaaacgtttaaaccttaacgtaacccgtaaagtaccgtttacggtaagggttaccggtaaacgggtaccccttaacgtttaaccccgaaaccccgtaccccgttaaccggaaacgggtaaaccccgtaacccggaaacccgttaaccccgaaaaacggtaacccctttaccgaacccgtttaacggttacctaccgtaacgaacctaaaacgttacggaaacctaccgggtaccagggtaacgtaacgggaccggtaacgacccgtaacggtnttcggttaacgtatttaccggtgtagacggtagacgtacggaccgggaggtactacgacggtactcggttacg

SEQ ID NO: 44500 - DNA, 801 bp, Homo sapiens
  misc_feature: GYAE6OF01DCQA4.7.85.H08.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
tcagcgtgtctctacacgaccggtgctcgatttagtatcactcagtcgcgggggctctcagagaggtgccttagccctggattccaaggcatttccacttggtgatcagcactgaacacagagactcacagtggaggttgggctgtgtcgttggtttccttgttgtcttagtttaagagtntacaatgtggaggtnacgagcgtgggtggtaggtcggtgggggagtcgttggtacgaggtccggtcggggggtcctggacgtactccgtcgtgtcgcgacgtcccttgtcggttactttacctacgttaacgttacgttagcggtataacggttacgtaacgggttcggacccgtacggaccggtcgtaaccgggaggggggaacggtctaggccgtaggttcggttacacgtaactaagttaaacgagtaggtaacgacgtaacaactaactacaactactacgtgttagaacggaacgggtcctaataccccgtactacccgaacgtacgaaacggaccgaaccgaaccgaaacgtaccgtactacgtacgtaccttacgaacccgaagaaacccaaaggtaacccgtaggtaacccgttaggggaaacggtaaccgggttaaacgaaaccgggtaacccggtccggggttaatttacgggttaaaccgttaaaggttttccgtcggggttaacggaaaccggggtaacggtaagggttaacccgggggtaaacccgggggttaacgggttaaaccggtaaaccgtttaaggaaacccggggttctttaaccccgggg

SEQ ID NO: 44501 - DNA, 745 bp, Homo sapiens
  misc_feature: GYAE6OF01BD0AU.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggaggttggggctgtgcttgggttttccttgttgtcttattttagaaggtgtccaatgtgaggtgcagcgtggtggagtcgtgggggagtcttggttcaggccggtcgggggtccctgacgtactctccgtgtgctacgtccttcgttacggtactttaccgttctaacgtacttagtgctagtaggtaaccgttcggggtcccgcgacggtccgtaccggaaggggacgggtcctcggcggtaggtttcggttacaactaactaagttaaacgtacgtaaggtaaggtacgaacctaacttaaacctacgactagtacctcgtagtaacggacgggtcctaactcccgaaccctacccgtacgacggtaacgaaccggaccaacccgaaagtacctacgaccgtttgtaccttcgaacgtaactaaaggtacgaaccgtacgtacccggtaagtccggaaacgggtccggaaaccgggtaccgtaccggggttattacgggtttacttaaacggttttaccgtagggtacggacggtaacgggtaacggtaaccgggtacgggggtaaacggggttaccgtaaacgtttaccgaaccgtttagtacccggg

SEQ ID NO: 44502 - DNA, 843 bp, Homo sapiens
  misc_feature: GYAE6OF01CVL28.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagaggactcaccatggagttgggctgtgctgggtttccttgttgctattttagaaggtgtccaatgtgaggtgcagcgtggtggagtcgtgggggaggtcttggttcaggccgtggggggtccctagagactcgtcctgtcgcgacgtcctcgtggttaactttaccgttactacgttacttagtggactatcggaacgtcggtccgaccgaaggtccgtaccggaggggaacgggctacggtcgtaggttacgggtttaccaacgtaactaacgtttaaagtaccgtaagggtaaagtaaccggaaccctaaagttaaccgttaacaacgtaacgtacccgttacgtacggtacggtaaacggggtcccgtaagtttacccgaacccgtacccgtaccgtaaaggaaccggaaacccggaaccgtaacccgaaaaggttaaacccttacccgaacgtttaccggtaccttaaccgtaacgggtaactaaaaccgttacggaaacccgtaacgtcccggtaacgggtaacggaacggttaccggggaaacgggtaaccgtaaaccgggttccgttaaggggttaacccgtttaagtttaaaccgggttcggggaaccgggtaaccggtaaacgggaaccgggtaaacccgggttacccgggggtaaacccgggggtaaacttttaccgggaacgttaaacccccggttaagtttaacccgggg

SEQ ID NO: 44503 - DNA, 711 bp, Homo sapiens
  misc_feature: GYAE6OF01BSEBG.7.85.H08.1.454.CMB.1.raw
  modified_base (701)..(701): a, c, t, g, unknown or other
  misc_feature (701)..(701): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggaggtcgtgggggaggtctttcggttcgaggtccggtcggggggtccctgacgtctctccgtgtcgcagtcctcgtcggtacttttacccttgagttacttagtcggctagtacggtaaccggttcggggtcccgcccggacggtccggttacccgggaaggggggaacggggtccgtggtaccggttaagggtttcgggtttaccaacgtaactaagtttaacgtacgtaaggaacgttaacggacctaattaaaccttaacacgtaacgaccttcgtaggtacgggaacggtaccgtacttccaacccgtaccgtaccgaaggacgacgaccgaaccaaacgtactctactcgtacctgtacgaactaaacgtcgaaccgtaaggtcctaagggtaagcggttaacggacggtacgaccgggtatcggttacttacgttacgtcggtagacggtagaccggtaggacccggggtagggtaactaggaacgtacnggttacccgg

SEQ ID NO: 44504 - DNA, 869 bp, Homo sapiens
  misc_feature: GYAE6OF01AD0FR.7.85.H08.1.454.CMB.1.raw
  modified_base (429)..(429): a, c, t, g, unknown or other
  misc_feature (429)..(429): n is a, c, g, or t
  modified_base (787)..(787): a, c, t, g, unknown or other
  misc_feature (787)..(787): n is a, c, g, or t
  modified_base (806)..(806): a, c, t, g, unknown or other
  misc_feature (806)..(806): n is a, c, g, or t
  modified_base (845)..(845): a, c, t, g, unknown or other
  misc_feature (845)..(845): n is a, c, g, or t
tcagcgtgtctctacacgaccggtgctcgatttagtatcactcagtcgcgggggctctcagagaggtgccttagccctggattccaaggctatttccacttggtgatcagcactgaacacgaggacggactccgaccagtgggaggttggggctgtggtcgtttgggttttccttgttcgtctttagttttaggaaggttcgtacctaagttggtaggaggtggccgaggtcgtgggtagggtacggttcgggtggggggtaggtcggtttcgggttaccgacgggtcccgggttacggggggttccctaggtacgtaccttccgttccgttgtcgaccgtacgtcccttaggtacgttaccttttacccgtcgttaagtttaccgtttagcggtacctaaggtaccggtaacggttccggggtacccncggtaccggtcccggtaaccggggaaggggacggtcgtaggtccggtttaggggttccgttaaccaagttaaccgttaagtttaacggtacggttaacggggtaacgttaaaccgtaacttaaaccgttaccttaaccgaacgttaccgttacgtacggttaacgggaccgggtaccgtaacgttacccttaccccgaaaccccgttaccgacccggtaacggtaaccggaacccgtaacccggaaactaacccggtactccggtaaccttcgttaaccctcggaagtaacctaacggtacgacccggttaagaccggtagggtaaagtcccgggtaagacccggtcgtacgggtttntacggttagtacgttcggnggtaccgaggtacggacgggtagggtccgtaacgggttntaaccgtcggattacggggtccgg

SEQ ID NO: 44505 - DNA, 838 bp, Homo sapiens
  misc_feature: GYAE6OF01ESKWQ.7.85.H08.1.454.CMB.1.raw
  modified_base (226)..(226): a, c, t, g, unknown or other
  misc_feature (226)..(226): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcggtggggaggcttggttnagccgtgggggtccctgagctctcctgtgcagcctctaggtactttacctctagtacttatggactagttgaacgttcggggtcccgaccggtacgggtccttacccgggaaggggaaccgggggtcttacggccggtaagggtttacggggttttaccaaccgtaacctaagttttaaaacgtaccggttaagggtaaaacggttaacggggtaaccctaaacgttttaaaaccgttaaccgtaaacgtaaaccggtaaccgttttcggtaacggttaacggggaaacggggttaccctaactttacccgaaacccccgttaacccgtaccgaacgggtaaaccgggaaccgtaacccgaacccgaaaaggtaccctaccgtaacctacggtaccttaccgacggtaaccaagtaaccggactaaccggtaccgtaggtaacggtacggtaccgggtaacggaccgttacggacggtttccgtttagggttaaaccgtttcggttaggttaccgggaacgggtaaaccgggtaaacgggtacccggttacccggggggtaaacggggttaacgttaaccggtaccggtaaaccccgttagggttaaccggg

SEQ ID NO: 44506 - DNA, 1009 bp, Homo sapiens
  misc_feature: GYAE6OF01AO13R.7.85.H08.1.454.CMB.1.raw
  modified_base (984)..(984): a, c, t, g, unknown or other
  misc_feature (984)..(984): n is a, c, g, or t
tcagcgtgtctctacacgaccggtgctcgatttagtatcactcagtcgcgggggctctcagagaggtgccttagccctggattccaaggcatttccacttggtgatcagcactgaacacagacgactcacatggagttgggctgtgtcgttggttttccttgtgtcttagtttagagtcgtactaagtgtgtagtcgacgagcgtggtacggaggttcggtaggggtacgtgttcggttacgacggtcccgggtcgggggttaccctacggtaacgtaccgttccgtttccgtcgggttcgacccgtaaccgtccccgttttaccggttaacgtttaacccgtttttacccgtttaacgttaaacggttttaccgtttttaacgggaccgtaaccgttaacggttaccggggtttaaaccgggttaccccgggggttcccgaacccgtaccggggtacccgtttaacccgggggaaggggggtacccggggtacgttacggtaaccgggttaacgggttttaccgggttaacctaaacggttaacctttaaacgggtttaaacccggtttaaggggaaacgggttaaaaccgggttaaaccggttaaacccctttaaacgtttaaaaccccggttaacctaaaacccggttaacgtcccggttttaaggaaaccggggttaaacccgggttaccgggttaaacccctaccgtttaaccctaaacccccggtaaccctttaaaccgggacggttaaacccggaacccgggtaacctaaacccccgggaaaatttaccgtaaccggttcccgttaagtaccgttaacccgaagtttaaaccccgaaagttaacggaccgtaacccgtcgtaacggggacggtttaaccgacgggtaacccgtaacggtcgttacggtacggttattacccggttaagtccggtaggtacgaacgggtaccggtagggtacggtaacggttacgtanaaccggttaacgtgttaaccccggg

SEQ ID NO: 44507 - DNA, 794 bp, Homo sapiens
  misc_feature: GYAE6OF01CW2E7.7.85.H08.1.454.CMB.1.raw
  modified_base (165)..(165): a, c, t, g, unknown or other
  misc_feature (165)..(165): n is a, c, g, or t
  modified_base (782)..(782): a, c, t, g, unknown or other
  misc_feature (782)..(782): n is a, c, g, or t
tcagcgtgtctctacacgaccggtgctcgatttagtatcactcagtcgcgggggctctcagagaggtgccttagccctggattccaaaggcatttcccattggtgatcagcactgaacacagagactcacatggagttgggctgtgcgttgggttttcttgttgnttatttagaagtgtcaagtgtgaggtgcagcgtaggtggaggtcggtgggggaggtcgtttgggttcgacggtcccggtacggggggtcccttggaacgtccgttctccgtggtcgccgtacgtcccgttgttacggtacttttacccttactaagttacgtttagtacggcctagtacggtaacggttcgggtcccgaccgtacggtccgtaccgggagggggaacgggtcgtacggtacgtagggtttcggttacaaccgtacgttaatttaacgtaaccggtaggggtaaacggtaaccggtaacctaacttaaacgtaccaacgtacgtacttcggttaggtacgggaaccggtcctaacgtttcccacccctaacgtaccgtaagaacggaacccggaaccggaaacccgaacggtaaccctaccgtaccgtttacgtacccgtctaacgtaaccgtaaacgtacgaaaacccgtccggttaccccggtaaggaaccgggtacgttaaccgggaaccggggtcctaacgggttacttacggttattacccgttagttacgggtagacggtaagggtaccgaagggtccggggaaaggttaacgtcggtaacncggtataccggg

SEQ ID NO: 44508 - DNA, 763 bp, Homo sapiens
  misc_feature: GYAE6OF01AQ2K8.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttgggctgtgcgttgggttttccttgttgtcttatttaggaaggtgtaccaagtgtgaggtgcagcgtggtggagtcgtgggggagtgttggtcaggtccggtcgggggttcccgtgaggaccttctccgtgtacgcgtacgccttaggtacgttattttacccttacgtacgttactttacgtacggtctacgtacggtaaccggtccgggttcccggaccgcggtaccaccgggtaggggacggggtactcggacggtacggtttcggggttacaacgttacgtagtttaaacgtaacgtaggtaacggttaaccggaacgtaacttaacgttacaacgtaccgtaagttcctagggtacgaacggaccgttacgtactaccctaccgaccgaacgaacgaacgggtaccaacccggtaaacaaccgttctaaccgtacgtacccgtttagacccgtaagtaaaccgtacggtaaccaacggtccgtagtaacggcgtaacgggacggtaccgtaccggtagtggttaccttacgttacgttcggtacggtacggtaacgaacggtaccgggtaaccgggggtacggggtaacttaagggtaccacccgggttagttacccggg

SEQ ID NO: 44509 - DNA, 1017 bp, Homo sapiens
  misc_feature: GYAE6OF01D4XUV.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatgggaggttggggctgtgtcgtttgggttttccttgttgtctttagttttaaggaaggtgtacctaagttggtggtaggtgacgaggtcgttgggtagggtaggttacgggtggggggtaggtcgttttgggttacgacggtcccgggttcggggggttcccctaggtaccgtaccgttccgttccgttggtcgacgtacgtcccgtttacggttacggttaacctttttacccgtttacgtaacgtttaacgttttagtacggtactaagttacgggtaaccggtttccggggtaccccgaccggtaccgggtaccgtaccggggtaagggggtaacgggtcgttaggtaccggttagggttttaccgggtttaaccaacgtaacttaaagtttaaacgtaacgggtaacgggtaaaacggttaaccggtaaccttaaacgtttaaaccgttaaccgtaaacgtaacggtaacccgtttacggtaacgggttaacggggtaaccggggtacccttaccgtttaaccccgaaacccccgttaacccgtacggaaacgggtaaccggaacccgaaccgtaacccgaaaaggttaaccgttacccgttaacgttccggtttaccctacggtaacgtaaaaccgttaaacgtacggaaaccggtaccggttaacccggtaagggtaaacgggttaaccgggaacgggtaaacccgggaaccgggttaccggttccgggtttaaagtttaagggtttaacccttttaggggtaccgggtaacggtaacggggtaaaccgggtaccggggtttaacccggggaacccgggggggtaaagggttttaaccctaagggaccccgtttaaacgggtcgttttaaccccggggg

SEQ ID NO: 44510 - DNA, 841 bp, Homo sapiens
  misc_feature: GYAE6OF01CX04T.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcgttgggttttccttgttgcttattttagaggtgtcaagtgtgaggtgcagcgtgggtggagtcggtgggggaggtcgtttggttccaggtcccggttcggggggtcccctggaacgtccttccgtccgtggtcgcgtacgtccttcgtaggttacttttaccgttacgaagttacttagtacggctaagtacggtaaccggttccggggtcccgaccgtacggtccgtacccgggaagggggaacgggtccgttaggtaccgttaagggtttccgggttttaaccaaccgtaacgttaaatttaaacggtaaccggtaagggtaaaacgggttaaccggtaaacctaaacgttttaaaacctaaccgtaaccgtagttaccgttacgttagggtaacgggtaaacggggtcccttaaacgttaccccaacccgtaaccccgtaacgaacggtaacccgacccggaaccaacccgaaacgtaccctactaaccgttcgtacctccgtaagtaacctaaaagtacggaaaaccgcgtaaccgttaggaacgggtacggtacccggaaggacccgtacggttacgttcggtttaaagttaccgtttacggtcggtacggaacggtaacggtaacggtaccgggttaccgggggtaaacgggtacctaaggaaccgtaccgaaggtttaacccggg

SEQ ID NO: 44511 - DNA, 767 bp, Homo sapiens
  misc_feature: GYAE6OF01BJKBY.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgcttgggttttccttgttgcttattttagaaggtgtccaatgtgaggtgcagctggtggagtcgtgggggaggtcgttggttcaggtcccggtcggggggtcccctggacgtaccttccgtcctgtcgcgacgtcctcgttgtactttaccttcagttacttatggacctatacggtaacgtcgggtacccgaccggcggccgtaccgggaaggggtaacggggtcgtaggtcgttagggtttcgggtttacctaactaacgtaactttaaacgttaacgtagggaaaggttaaccggaactaacgttaaaccttacaacgtacgtacttacggttacgtacgggtacggttaccggtacttaccaaccccgtacccgtaccgaacggacgtaaacccggaccgaaccgtaaaacgtacctaccttacgtacgtttccctaactacggaactaacgtagaaaccgtacggacctcgggaaaggtaccggtaacgggtaaccggtacccgtaaccgggtcgttacggttagttacgtttaccggagggttaccgacggaggttacgggaaccgggtcgggggtaacggtagtacggtaacccgacggttacgttacccggg

SEQ ID NO: 44512 - DNA, 938 bp, Homo sapiens
  misc_feature: GYAE6OF01BNHPE.7.85.H08.1.454.CMB.1.raw
  modified_base (816)..(816): a, c, t, g, unknown or other
  misc_feature (816)..(816): n is a, c, g, or t
tcagcgtgtctctacacgaccggtgctcgatttagtatcactcagtcgcgggggctctcagagaggtgccttagccctggtattccaaggtcatttccacttggtgatcagcactgaacacagaggactcacagtggagttgggctgtgtcgttgggttttccttgttgtacttattttagaaggttcgtccaagtgtgaggtgcgagcgtgggtggagttcggtgggggagtcgttgggttcaggccggtcggggggtccctggacgtctccgttccgtgtcgcacggtccttcgttacggttaacttttacccgtttacgtaacgtttacctttaaggtcgggtactacggttacggtaacccgggttccgggggtaccccggtccggtaaccggggtcccggttaaccggggaacgggggggtaaccgggggtcgttacgggtacccggttagggttttacggggtttaacccaacgttaacgttaaacggttttaaacggtaccgggttaagggtaaaacggttaacccggaaaaccctttaaacgtttaaaccctttaaaccgaaccgttaaccggtaaaccgtttacgggtaacggttaacggggtaaacccggggtaccctttaccttaacccgaaacccccgtaaccgttaacccgaaagggtaacccgaaaacccgtacccggaaaccccgaaagtaaccttccgtaacgttacggttcccgtaccgttaaggaaaccctaaaggtaccgaacgaaccgggtacgtaacgggagttaccggaaccgggacggtaaaccgccgggttnttaacgggtttacgtaacgtttaccgtagggtaccgggtaaagacgggggttaacggtaccccggggaccgggggttaaagggttacccgtaagtaaccccgggtacgtggttaaacccggg

SEQ ID NO: 44513 - DNA, 749 bp, Homo sapiens
  misc_feature: GYAE6OF01CBN20.7.85.H08.1.454.CMB.1.raw
  modified_base (661)..(661): a, c, t, g, unknown or other
  misc_feature (661)..(661): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagcgtggtggagtcgtgggggagtcgttggttcagtccggtggggggtccctggacgtacctcgtccgtgtcgccacgccttcgtggtacttttacccttcgtacgttacttagtcggcagtcgaacgttcggggtcccgccgacggtccgtaccgggaagggggacgggtcctcggtacgtagggttcgggtttaaccaaccgtaactaagtttaacgtacggtaggtaaacgtacggaacctaagttaaaccttacacgtaacgtacgtacgttaggacggtaacgggtacctacttacccgaaccctccgtaccgaaggaccgaacccgtacgaacccgaaagtacctcaacgttcgtaccttcgtacgaactaaagtacgaaacgtccggtaccgttagggaacgtacgggtaccggaaccggtacgtaccggtcgttaacgttagttaaccgtttcggngggttacggaacggtaacggtacggaacccgggttaacccgggggtaacgggttaaccgttagtaacccggaacgttcggtaaccggg

SEQ ID NO: 44514 - DNA, 901 bp, Homo sapiens
  misc_feature: GYAE6OF01BBA6F.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgtcttgggttttccttgttgtcttattttagaaggttgtccaatgtgaggtgcagcgtgggtggagtcggtgggggtaggtcgttggttcaggcccgttggggggtccctggacgacttccgtccgtggtcgccgacgccgttcgttacggtactttttacccttcgtaacgttaacttttagtcggtactaacgttacggaaccggtttcgggggttaccccgacccggtagggtacccgttaccgggaaacggggggtaacgggggtccttacgggacggttaacggggttttcggggttttacccctaaaccgtaacgttaaacgtttaaaccgtttacggtaaaggggtttaaacgggtaaccggtaaacccgtaaacgtttaaacctttaaaccgtaaccgtaaacggtacctttaccggtttagggtaaacgggaaccgggttacccggtaacttttaccccgaaacccccgttaacccttaaccgggaaacggtaacccggaaaccccggcccgttaaaccaaaaccggttaacccttacgtaccggtttacgtttccccttaccggacgttaaaccctaaacgggttaaccaaacgtaccggtaccgtaggggtaaaccggtacggttaacgaacgggtaaccggcggttaacttggggtttacgtaatttccgggtagtacggtaggaaccgtcgggggaacgtcccggggtaagggttactactcggtaaaccgtggtaccggg

SEQ ID NO: 44515 - DNA, 646 bp, Homo sapiens
  misc_feature: GYAE6OF01DKVX5.7.85.H08.1.454.CMB.1.raw
  modified_base (294)..(294): a, c, t, g, unknown or other
  misc_feature (294)..(294): n is a, c, g, or t
  modified_base (536)..(536): a, c, t, g, unknown or other
  misc_feature (536)..(536): n is a, c, g, or t
  modified_base (639)..(639): a, c, t, g, unknown or other
  misc_feature (639)..(639): n is a, c, g, or t
tcagcgtgtctctacacgaccggtgctcgatttagtatcactcagtcgcggggctctcagagaggtgccttagacctggattccaaggcatttccacttggtgatcagcactgaacacagaggactcaccatggagttgggctgtgcttgggttttccttgttgctattttagaaggtgtccaatgtgaggtgcagtcgtggtggagtcggtgggggagccgtttggttcacgtccggtcgggggtcccctgagaccttcgtcctgtcgcacgccttcgtggtactttaccctntagttacttaagtggacaagtgtaaccgtcggtacccgcgacggtccgtccggaggggaacgggtcgtggtaccgtagttcggttacacgacctattaagtacgtaggaatacggacaacgtaacttacacacgtctcgtgtagaacgggtccgtaacttccgaacccgtaacctcgaagtacggacgaccaccgaaacgaacctccgtaaccgtagtctactacgaaccgtaatcgaaacncgtaccgaggtaagtacgtacgaacgacgtacgcgttaggtcgttaacttggaccgtaggaggtaagacgttaggtacccgggtagggtaactgaacgtacgngttacgg

SEQ ID NO: 44516 - DNA, 748 bp, Homo sapiens
  misc_feature: GYAE6OF01D587V.7.85.H08.1.454.CMB.1.raw
  modified_base (251)..(251): a, c, t, g, unknown or other
  misc_feature (251)..(251): n is a, c, g, or t
  modified_base (332)..(332): a, c, t, g, unknown or other
  misc_feature (332)..(332): n is a, c, g, or t
tcagcgtgtctctacacgaccggtgctcgatttagtatcactcagtcgcgggggctctcagagaggtgccttagccctggattccaaggctatttccacttggtgatcagccactgaacacaggaggactcaccagtgggtaggttggggctggttggtcgtttggggttttccttggttgtcgttaattttaggaaggttgtacctaagtggtggaggtcgcaggtcgtgggtggaggtcggtagggggngtcgttggtcgacggtccggtcgggggtccctgacgtactcgtcgtgtcgacgtcgtccgttcgtacggttactttacctntacgttacttagtcgactagtacgaccggtcgggtacccgacggacggaccggtcggaggggtacggtcgtggtcggtagggttcgttacaaccgtaagtaaacgtttaaacgtacggtaaggtaaacgtacggaacctaacgtaaacgtacaacgtagtaccgttaggacggttaagggacgtaccgtattacccgaccctaccgtaccgagtaaccggtaccgaacctacgtaaagacctacgtaaccgtaccgtccgttaccgtaagtaacctaaaggtacctaacggaccgttaacggagtaacggacggttaaaccggcgttaccgacggtattaggttaccgtaaggttcggtagagggtccggaagtaggaacgggtcgggtaacggacgtactacggactggtaccgg

SEQ ID NO: 44517 - DNA, 840 bp, Homo sapiens
  misc_feature: GYAE6OF01CNBPD.7.85.H08.1.454.CMB.1.raw
  modified_base (822)..(822): a, c, t, g, unknown or other
  misc_feature (822)..(822): n is a, c, g, or t
tcagcgtgtctctacacgaccggtgctcgatttagtatcactcagtcgcgggggctctcagagaggtgccttagccctggattccaaggcattttccacttggtgatcagcactgaacacagaggactcacctagtggaggttggggctgtgtcgttgggttttccttgttgtacttagttttaggaaggttcgtaccaagtggtgaggtgcagtcgtggggtgggaggttcgggtggggggtaggtcgttttgggttcgacgggtcccgggttcggggggtccctaggacgtccttcctccgtgtcggcgacgtccgttacgttacggttaacttttacccgttagtaacggtttactttagtcggtactaggtacggtaaccggtccggggtcccgaccgtacggggtcccgtacgggaacggggggtaacggggtcttacggacggttacgggtttcggtttaccgaaccttaagttaaacgtttaaacgtaacggttaagggtaaaacggtaacggtaaccttaaactttaaaaccgtaacgaacggtaacgtaaccgttacggttaggtacgggaaccgggtacctaccgttaccccaacccgtaccgtacgaacggtaacgacccgggaacccaaacctaacggtaaccctacgttacgttaccgttacgttaaccgtacgtaaactaaaaggtccgaaaaccgttccggaaccggtagtaagggtaaccggttcggaacggacgtaccgggtagttcgttaggtttactacgtgggaggacggtaagcggttaccgggacggggtaggttaacgntacgtacctgggttaccg

SEQ ID NO: 44518 - DNA, 882 bp, Homo sapiens
  misc_feature: GYAE6OF01D5NHA.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagaggactcaccatggagttggggctgtgcttgggttttccttgttgctattttagagtgtccaatgtgaggtgcagcgtggtggagtcggtgggggagtcgttaggttcacggccggtcgggggggtcccctaggacgtacctccgtccgtaggtcgccacggtccctcgttacgggtacttttacccttacgtaacggtttaacctttagtacggtacctaagttacggtaaaccgtttcggggggttaccccgacccggtaacggggtcccttaccccggggaagggggggtaaaccggggtccgttacggggacccgttaacggggttttcgggggtttttaacccaaccgttaaaccgttaaagttttaaaccggttaccgttaaacggggtaaaccggttaacgggaacccttaaattaaaacccgtttaaccgaacgtacgtaacccgttacgttagggtaacgggacgggtacccgtaactttacccgaaccccgtaccttaccggtaaaggaccgtaacccggaaccgtaccgtaaacgtacccgttacccgtaactcgtttacccttacgttacgaaccgtaaacgtcgaaccctacgggtccctaggaaacgggtacgtaccgggaacgtaccgaacggtgttcgttaacggttactttacggtgggtacgaccgggtaaaggacgggtaacccgggttaccggggtacggggttaacccttaacggtccgaaaccgttcggtaacccggg

SEQ ID NO: 44519 - DNA, 1070 bp, Homo sapiens
  misc_feature: GYAE6OF01EF1FZ.7.85.H08.1.454.CMB.1.raw
  modified_base (204)..(204): a, c, t, g, unknown or other
  misc_feature (204)..(204): n is a, c, g, or t
tcagcgtgtctctacacgaccggtgctcgatttagtatcactcagtcgcgggggctctcagagaggtgccttagccctggattccaaggctatttccacttggtgatcagcactgaacacagagactcacagtggaggttgggctgtgtcgtttgggttttcttgttgtacttagttttagaaggtgtacaatgtgaggtgcgngtcgtggtggtaggtggtggggtagtcgttggttcgacggtccgggttcgggggtcctagacgtccttcgtccgtgtcgcgtacgtccgttcgttacgttactttacccttacgtacgtttagttagtcgtactagttacggtaaccggttccggggtcccgtaccggaccgggtaccggttaacccggggaaggggggtaccggggtccgtaggtaacggttacgggttttaccggttaacctaaacgttaacttaaacggtttaaacgttaacgggtaaggggtaaacggtaaaccgtaaaccgttaaaccgtttaaaccctaacgtaaaccggtacgtttaaccgttcgggtaaacgggttaacgggtaaacccggggttacccctttaacttaaaccccccccggtaacccccgttaaacccgtaaacgggaaaaccgtaaaccccggggtaaaccccgaaacccccggtaaaacccgtaaaaaccccggtttaaccccttcccggttaaccgtttacccgttaaccccggtttacggaaaaccggttaaaaacccgttaaaaacccggtagtaaaacccccgggtaccggttttaaacccgggaaagggggtaaaccgggtttaaaccccggaacgggggtaaacccccggacccggggttaaccggttagttttacggggtttaaaaccctttttccgggttaaaccggggtggggttaaacccgggaaaccggggttaaaacgggggtacccggggttaaaacccgggggggttaacccgggggggttaaacgggtaaaaacggttttcccggtttaaaaccggaaaccccggggtttggttttaaacccccggggggg

SEQ ID NO: 44520 - DNA, 673 bp, Homo sapiens
  misc_feature: GYAE6OF01DTJWX.7.85.H08.1.454.CMB.1.raw
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (622)..(622): a, c, t, g, unknown or other
  misc_feature (622)..(622): n is a, c, g, or t
tcagcgtgtctctacacgaccggtgctcgatttagtatcactcagtcgcggggctctcagagaggtgccttagacctggattccaaggcatttccacttggtgatcagcactgaacacaggagactcaccagtggagttgggctgtgtcgttggttttccttgttgtctttattttaggaaggtgtaccaatgtgaggtgcagcgtggtaggnggtcggtgggggagtcgtttggtcgaggtccggtggggtcctgagctcgtctgncacgtcctgtcgtactttaccttcgattactagtgactagtacggtacgtccggtccgacgtacgccgtaccggaggggtacggctgacgtacggttcgttacactataagttaactcgtaaggaagtaccgtaactaacgttaacctacgaactacgtaccttggtagtacgggtaacggtacctaagttaccccacccgttaaccgtaccgaacggaccgtaaccggaacccgaaacgtaacgtaaccgtacctaaccttcgttaccacgttaacgaactaaacgtacgaaacgtacgtacgtacggtagacggtacggtaacgacgtcgttaacgtgtaaccgttgttacgnggtacgacggtaagacggtccgtaggggcgtaattgaacgtgttacggtcg

SEQ ID NO: 44521 - DNA, 774 bp, Homo sapiens
  misc_feature: GYAE6OF01CKSG5.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagagactcaccatggagttgggctgtgcttgggtttccttgttgcttatttagaaggtgtccaatgtgaggtgcagcgtggtggagtcggtgggggaggtcgtttggttcgacggtccggtcggggggtccctaggacgactcctccgtgtcgcgacgtccgttcgtacggttactttaccttacgtaacgttacgttaagtggtacctaggtacgtaacggtccgggtaccccgccgtacggccgttaccgggaagggggaacgggtccgtacggtacggttacggttacgggtttacaacgtaacttaacgttaaacgttaacggtaacggtaaacggtaacggtaaacctaaacgttaaacccttaacgaacgtacgacgttacggtacggttaggaaccggtcgtaaccttccgaaccctaccgtaacgaacggaacgaccgaaccgaacccgaagaacccttcgtaacgtcctttaccgccgttaacaacaaacgtaacgaacctaacggcctaaggacggtaccggttacggaaccgtacgtaccggttcttacgggtacgttaaactttcggtagtacggaacggtcggtaaaggtcccggtaacggggtaccgggtacgtactaaaccgggcgttaagttcccgggg

SEQ ID NO: 44522 - DNA, 862 bp, Homo sapiens
  misc_feature: GYAE6OF01AZBIC.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccagtggtaggttgggctgtgtcgtttgggttttccttgttgtactttagttttagaaggttcgtacctaagtgtggtaggtgcgagtcgtgggtggtacggttcgggtagggggtacggtcgtttcgggttacgtacggttcccggggttccgggggggttaccctggtaaccgtcgttccgtcgtggtcgacgtacgtccttcgtagttacgtttacctacgtagttacttagcgtacgtagtacggtaacggttcgggtcccacggtcggtaccggtacgggaacgggggtacggtcgtaggcggttacgggtttacggttaaccacgtaacgttaagttaacgtacggtaacgggtaaaggtaaccgtaactaacgttaaacctacgtaactacgtacgttacggtaggtaacggaaccgggttactacgttaccccgaacccgttaaccgtaccgaaagggttacccgaaccggtaaacccgaccgaaaccggtaccttaccgtacgttcccgttacgtaccgtacgtaaaacgtacgttaacgaaccgttaccggtaacggtacggtaaacggtaccgggttaaccgaaccggttacctaccggggtttaacgttaggttaacccggttaacgtttaaccgggcggtaccggttacggaaacggtcggtaacccggggtaacggggtacggttaacgttaccggaaccgaaccgttggttacccggg

SEQ ID NO: 44523 - DNA, 659 bp, Homo sapiens
  misc_feature: GYAE6OF01BUPCJ.7.85.H08.1.454.CMB.1.raw
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
  modified_base (540)..(540): a, c, t, g, unknown or other
  misc_feature (540)..(540): n is a, c, g, or t
  modified_base (596)..(596): a, c, t, g, unknown or other
  misc_feature (596)..(596): n is a, c, g, or t
  modified_base (607)..(607): a, c, t, g, unknown or other
  misc_feature (607)..(607): n is a, c, g, or t
tcagcgtgtctctacacgaccggtgctcgatttagtatcactcagtcggcgggggctctcagagaggtgcccttagccctggattccaaggctatttccacttggtgatcagcactgaacacagacgactcacagtggagttgggctgtgcgtggttttccttgttgcttatttagagtcgtcaatgtgagtgcagcgtggtcggagtcgtggggtagtcgttggtcgaggtcccgtgggggtccctggacgtctcctcgtgtgcgtacgtcccttgtacggttactttacccgtataacgtaccttagtcggtcctagtcggtaacgttcggggtacccggtaacggctccggtaagggacggttcncgtacgtaggttacggttacactatacgttaacgngtacgtaagaccgacctataaccttacacgactagcttagcgttaacggctactcaaccgctacgaacgtcgaacgtaccgtaacactacgtactaaccgtgacttcaaggtactaacgtacgacgtaacgtaccgngtaacggtacgaccgaagtacgaccgttacgtacgtacggtactacggtaccggtnttacccggganacgttaccggacggtaaccccggttagtaaccgtcgaaccgtcggtacccgg

SEQ ID NO: 44524 - DNA, 638 bp, Homo sapiens
  misc_feature: GYAE6OF01ESRVS.7.85.H08.1.454.CMB.1.raw
  modified_base (258)..(258): a, c, t, g, unknown or other
  misc_feature (258)..(258): n is a, c, g, or t
  modified_base (504)..(504): a, c, t, g, unknown or other
  misc_feature (504)..(504): n is a, c, g, or t
  modified_base (632)..(632): a, c, t, g, unknown or other
  misc_feature (632)..(632): n is a, c, g, or t
tcagcgtgtctctacacgaccggtgctcgatttagtatcactcagtcgcgggggctctcagagaggtgccttagccctggattccaaggcatttccacttggtgatcagcactgaacacagagactcaccatggagttgggctgtgcgttggtttccttgttgctattttagaaggtgtccaatgtgaggtgcagctggtggagtcgtgggggaggtcttggttcgagtccggtcgggggtccctgagactctcctgngtcacgcctcgtggtacttttacctctaacgttacttgtggctatgaacgttcgggcccgcgaggccgtaccgaggggacgggcgtgcgtagttcggtttacactaactacttaaagtagtacggaagtacggaactaacgtaaactacaactacgtattcgtagtacggtaacggaccgtacttaccgaaccctacctacgagacgaaccgtaaccggaccaaacgtaaccaccgtttttttacncgttactcgtagactaaacacgacaacgaccgtagtacgtacggtacgacgtaccgacggtcgtagtacgttacgttaacgtgtaggacgtagacggtacgacgggtacgggtacgtagtacgtacgngtacgg

SEQ ID NO: 44525 - DNA, 728 bp, Homo sapiens
  misc_feature: GYAE6OF01AV7F9.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcgttggttcaggccgtggggggtccctggacgactctcctgtgcagcctctggtactttaccttcagttacttatggcatgacgtgggtcccgccgaggcctaccggaggggacggggctgcgtaggttcggttcacgactagttaatacgtaggaagtaggaacctaacttaacttacaacgtacgacttcgtaggtaggaacgggtcctaactttccaaccctacccgttccgaaacggtaaccgaaccggaacccgtaacccgaaaacggtaacccttccgaaccgttcggtttacccttaccgtacggaaaccgtaaaacgttacggaaaacccgtacggtaccccgtaagggtaacgggtaccgggttaacgggaaacgggtaacccgtaccggggtacttacgggtttacgttaacgtttaccggttgggtacggaccggtaagggacggtacggtacccggggtaaggggtaaccgttagtaccggaaccgtagttacccggg

SEQ ID NO: 44526 - DNA, 757 bp, Homo sapiens
  misc_feature: GYAE6OF01C69BU.7.85.H08.1.454.CMB.1.raw
  modified_base (142)..(142): a, c, t, g, unknown or other
  misc_feature (142)..(142): n is a, c, g, or t
  modified_base (190)..(190): a, c, t, g, unknown or other
  misc_feature (190)..(190): n is a, c, g, or t
  modified_base (275)..(275): a, c, t, g, unknown or other
  misc_feature (275)..(275): n is a, c, g, or t
tcagcgtgtctctacacgaccggtgctcgatttagtatcactcagtcgcgggggctctcagagaggtgccttagccctggattccaaggcatttccacttggtgatcagcactgacacagaggactcaccatggagttgggntgtgtcgttggttttcttgttgtcttattttagagtgtcatgtgagtncagcgtggtggaggttcggtgggggaggtcgtttcggttcgacggtcccggtcgggggtccctggacgtactccgttctgtgacngcttccgtgtacctttaccttctagttacttagtaggctagtacggtaacgtccgggttacccgcccggtacgggcccgttaaccgggaggggtaacgggtcgtgtcgtacggttcggttcaacgtacgtaattaacgttacgaggtaaaggtacgtaactacttaacgtactaacagtacctagtacggtacggacggtccgtacgttccacccgtaccgtaccgacggaacgaacggtaccgaaccgaacgttaactccgttaacgtcgtaccgtacgtacgtaacctaaagtacgtaaaccgtcgtacccggttacggaacggtacgggtaccggaaacgggtccgtaaccggtccggtttacggttacggttacgtttacggtcggttacccgggaacggtaacgggtaaccgggaaccggttacgggggtaacgggtttaacccgaggtttaacccggtccggtaagggttacccgg

SEQ ID NO: 44527 - DNA, 833 bp, Homo sapiens
  misc_feature: GYAE6OF01CHSV8.7.85.H08.1.454.CMB.1.raw
tcagcgtgtctctacacgaccggtgctcgatttagtatcactcagtcgcgggggctctcagagaggtgccttagccctggtattccaaggcatttccacttggtgatcagcactgaacacagaggactcgaccagtggagttggggtcttggtcgtcgttcgggttttccttggttgtcttagttttagtaagggttgtaccaagttggtggtagggtgacgaggtcgttagggtgggtacggttcgggtggggggtaggtcgttacgggttcggtacggtccggttcggggggtccccttaggaccgtaccgtcgtccgtggtcgtccgacgtccttacggtacggttaactttaccgttaccgtaacgtttacgttacggtcggtactacgtcggtaacggtccggggtacccggccggtaacggtcccgtaccgggaagggggtacggtcgtacgtcggtacgggtttacggttacgtacctaacggttaagtaacgttaacggtacggtaaaggtaccggtaactaacgttaaccttacgaacggtacgtacgtacgttacggtacggaacggtcctaccggttaccaacccgaccgtaccgaaggtacccgaacaccgtaacaaccgtactaccctgtacgtccctagacgtaacgaaccgtactaacccggagtacccgtaggtacggaacggttaacccggaaggtaccgtaccggtaccgttaggtacttaaggtttacggtcggtaggaaccggtaagttacggtacccggggtagggttaacccggggaagttaccggaacgttcccgggtgttaacccgggg

SEQ ID NO: 44528 - DNA, 891 bp, Homo sapiens
  misc_feature: GYAE6OF01CHY3B.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggaggttggggctgtgtcgttcgggtttttcctttggttgtactttatttttaaggaagggttcgtacctaaagttggtggagggtgcgaggcgttgggtgggaggtcggtggggggtacggtcgtttgggttcgacgggtccggtcgggggggtccctggacggtacctccgttccgtaggtcgccacgtccttcgtaggttaacttttacccgtttacgtacggtttaactttagtcggtactaagttacggtaaccggttcggggtacccgaccggtacggtccggtacgggaaggggggtacggggtcgttacggtacggttacgggtttcgggtttaccaaccgttaaacgttaaacgtttaaacgttaacgggttaagggtaaacggtaacggtaaacctaaacgttaaaacctaaccaacgtacgtaacgttcggttaagggtacggtaacgggtacccgtaacgttacccctaaccccgtaacccgtaaccgaaggtaaacccggaaccgtacccgaacgtaaaccgtactaccgtacgttcggtacctacggtaacgaactaaacgacgtaaccgcggtaccgaaggtacgggtaagtaacccgggtaacgaccgggttaacgttcggttacggttaagtttaaccgttacggtacgggtacgggtaacggtaagggtaacccgggtacggggttacccggggtaaggggttaacccgttagtaccccgggaagttacgttacccgggg

SEQ ID NO: 44529 - DNA, 856 bp, Homo sapiens
  misc_feature: GYAE6OF01EX7PW.7.85.H08.1.454.CMB.1.raw
  modified_base (842)..(842): a, c, t, g, unknown or other
  misc_feature (842)..(842): n is a, c, g, or t
tcagcgtgtctctacacgaccggtgctcgatttagtatcactcagtcggcgggggctctcagagaggtgccttagccctggattccaaggcatttccacttggtgatcagcactgaacacagagactcaccagtggaggttgggctgtgtcgttgggttttccttgttgtcttagttttaaggaggttgtacctaagtgtgaggtgcagtcgtgggtggaggtcggtgggggtagtcgtttggttacgacggtccggtcggggggtccctggacgtctccgtcgtgtcgcgtacgtccttcgtggttacttttaccgttacgtaacggttactttagtcggtactaagttacggtaaccggttccggggtaccccgaccggtaccgggtccgtaccggggaaggggggtaaccggggtcgttacgggacggttagggtttaccgggtttaccaaccgttaactaagtttaaagtaccggtaagggtaacgtaaacggtaacctaaacgtttaacctaacgtaactaacggtaccttacgtacgggtacggaacgggttccgtaactaccccgtaaccccttaccgacggtaacgtaacggtaacccggacccgtaaccgaaaacgtaccgtacctacgttccgttaccgttaccgtaagtaaacccgtaaacgtaacggaaccgtaccgtaccggtaagggtaacggtacggtaaccgggacgggtaacccgtcgggttactttagggttaacgtttaccgtttacggtccggttagggacggttaaagggaccgggtacgggtaaccggggaggggtttaacctaacggacgttaaaccgngggtttaccccggg

SEQ ID NO: 44530 - DNA, 892 bp, Homo sapiens
  misc_feature: GYAE6OF01AZKA0.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctatttagaaggtgtccaatgtgaggtgcagctggtggagtcgtgggggaggcttggttcaggtccgtggggggtccctggagactcgtcctgtcgcacgcctcgtcggtacttttacctcagttacttagtcggactagtcgtaacggttcgggttcccgcccgtaacgggtccgttaccggaagggggtaaacggggtcgtacggtaccggttacgggtttacggggtttaccaaaccttaaccgtaaagttttaaacgttaacggttaacggggtaaaacggttaaccgggtaaaccctaaacgtttaaacctttaaccgaaaccctaacggttaaaccgttaccgttagggggttaaccgggaaacgggggttaccccgttaacttttacccgaacccccgtaacccgttaccccgaaagggacccgggaaacccggttaacccggaaccctaaaacggtaaaccccttccgtaaccgtttaccgttaccccgttaggttaccgaaccttaaaacggtaccgaaacgttacccgggacccgtttaggaaccgggtaacgggtaccgggtaaccgggtacgaacccggggttcttaggttaaacccgtttagttaaaccgttgggtaaccgggtacggaaacggttaacggggtaaacccggggttcccgggggaacggggttaaacccgttaggacccggttaaaagtcccgttaaacggggg

SEQ ID NO: 44531 - DNA, 819 bp, Homo sapiens
  misc_feature: GYAE6OF01B0KH0.7.85.H08.1.454.CMB.1.raw
  modified_base (655)..(655): a, c, t, g, unknown or other
  misc_feature (655)..(655): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcacatgggaggttggggctgtgtcgttgggttttccttgttgtcttattttaggaaggtgtccaagtggtgaggtgcgagtcgtggggtaggaggtcggtgggggaggtcgtttgggttccgaggtcccggttcggggggtaccctggacgtactccgttccgtggtcgcacgtcctcgtggttaacttttaccgttcgtagttacttagcggctagtcgaacgtccgggtccacggacggccgtaccggaggggaacgggtctaggtacggttagggttcggttaccaactaacgttaaagttaaacgtacggtaagggaaagtaaccgtaactaactttaaaccgtaactaaccgacgtacttacggttaggtaaacgggtacgggtaacccttacgttaccccaacccgtaacccgtaccggaaggaaacccggtaacccggaaaccgtaacccaaaacggtacccgttactaccgttacgttaccctagtaaacggtaacctaaacggtacggaaacccgttanaccggtaagggaacggtaacgggttaaccgagggtaccgacggttacctttagggaacgttttacgttaccggtgggtaataccggggaaacggtacggttaaccggggacccgggggtaagggttaaaccctacggtacggaaacccggttagttacccgggg

SEQ ID NO: 44532 - DNA, 854 bp, Homo sapiens
  misc_feature: GYAE6OF01B513D.7.85.H08.1.454.CMB.1.raw
  modified_base (764)..(764): a, c, t, g, unknown or other
  misc_feature (764)..(764): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcgttgggttttccttgttgtcttattttagaaggtgtccaatgtgaggtgcagcgtggtggagtcggtgggggagtcgttggttcacggccggttcggggggtcccctggacgtaccttctccgtggtcgccacgtcctcgttaggtactttacccgttcgtaacgttacttagtcggactagtacggtaacgtcgggtcccgccgacggtcccgtaccgggaaggggacgggtcctaggaccggtagggtttaccgggtttacaaccgtaacgtaacgtttaaacgtacgttaagggaaacggtaccgggtaaacccttaaactttaaaccgttaaccaaccgtacgtaaccgttccgtaagggtaacgggaaccgggtaccttaaaccgtttccccaaaccccgtaacccccttacggaaaacggtaaccccggaaacccggtacccggaaaccccgtaaacgttaacctacccgttaaccgttcggttaccctacgtaacggaactaaaaccgttccgaaacgtaccggtacccgttagggaacggtaaccgggtaccggtaacgggaacccggtaaccgttcgttacggtttacggttaattttacccgggnggtttacggaacgggttaaacgaccgggtaaccggttacccggggggaagggtacccgtttaaggaccgtaaccggttagttaacccggg

SEQ ID NO: 44533 - DNA, 699 bp, Homo sapiens
  misc_feature: GYAE6OF01BKIBX.7.85.H08.1.454.CMB.1.raw
  modified_base (185)..(185): a, c, t, g, unknown or other
  misc_feature (185)..(185): n is a, c, g, or t
  modified_base (612)..(612): a, c, t, g, unknown or other
  misc_feature (612)..(612): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccagtggtagttgggctgtgtcgttggttttccttgttgtcttaagtttagaggtntacaagtgtgagtgcagtcgtggtaggtagtcggtaggggtgtcgttggtcgaggccggtcgggggtcctgacgtcctcgtccgtgcgctacgtccgttcgttaggttaacctttcccttacgacgtttaacttagtcgtactagttacggtaccggtcgggtacccgccggaacgcccggttagggaacgggggtaggtcctggtacggttaggttcggttaactacctaagttaattaaacgtaggtaacgggtaacggtaacgtaccctaaagttaaccctaacgacgtaacgtcgtacggtaggtacggaacggtcctacttacccgacctaccgtacgaggaactaaccgacgtaacgaactacgtctaagtctactcgagtaacctaagacaacgtaccgaccgtaagtcggacggtaacncggacgtaccggtctaggtcctttaggtacgtcgtacgaggtacgacggtcggtacggggtacgtacgattaccggattggtaccgg

SEQ ID NO: 44534 - DNA, 736 bp, Homo sapiens
  misc_feature: GYAE6OF01B4GB1.7.85.H08.1.454.CMB.1.raw
  modified_base (621)..(621): a, c, t, g, unknown or other
  misc_feature (621)..(621): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggaggttggggctgtgcgttgggttttccttgttgcttattttagaaggtgtaccaagtgtgaggtgcagcgttggtggaggtcgtgggggagtcgttggttcgaggtccggtcggggggtccctaggacgtactcctcgtgtcgctacgccttctggtacttttaccttcagttacttagtggctagtacggtaacggtcgggtcccgaccgtacgggccgttaccgggaagggggaacggggtcgtcggacgttagggtttcgggtttaccgaactaacgttaaacgtttaaacgttaacgttaaggggtaaacgggttaacggtaaaccttaaacggttaaacttaaccgaacgtaacgtaccttacggtggtaacgggaaccgggtaccgttacgttacccaacccgacctaccgaaggtacccgaaccggacccgaaccgtaaacgtaacctacgtacgtacgtctacgtacgactaaacgtnaaccgtacgacgtaggtaaggtcgtacggaggaccacgggtctagttagttactacgttggtacgaggacgtacggtacggtcggggaaggtactaggcggtaacctgtaaccgg

SEQ ID NO: 44535 - DNA, 798 bp, Homo sapiens
  misc_feature: GYAE6OF01C06WW.7.85.H08.1.454.CMB.1.raw
  modified_base (104)..(104): a, c, t, g, unknown or other
  misc_feature (104)..(104): n is a, c, g, or t
  modified_base (772)..(772): a, c, t, g, unknown or other
  misc_feature (772)..(772): n is a, c, g, or t
tcagcgtgtctctacacgaccggtgctcgatttagtatcactcagtcgcgggggctctcagagaggtgccttagccctggattccaaggcatttccacttggtnatcagcactgaacacagagactcaccagtggagttgggctgtgcttgggttttccttgttgcttatttagagtgtacaatgtgagtgcagctggtggagtcggtgggggagtcgttggttaccaggcccggtacgggggtccctggacgtacctcgtccgtgtcgactcgtccttcgtggttaactttcccttacagttactagtaggtacctagtacgtaaccgttcgggtacccgaccgtacggtaccgtaccgggaaggggtacggggtcctacggtaccggtaggttccgggtttaaccaaccgtaacgttaactttaacgtaaccggtaggtaaaacggttacgtaacccgtaaacgttaaccgttaacgaacctacggtacgttaccggtagggtaccggaacgggtcccttaacgttacccaaccccgtacccgttaccgaacggtaacggtaccccggaacccgtaacccgaacgttaacccgttacgtaaccgtttcgtaccgttccgtaaacgtaaccgttaaaacttacggaaacccgttcggtacccgtaggtacggtaccgtacggaacggtaccgtacggtctttacggatttacgttacggtggtaacgcgggtaaacgttcgggtaaccggttcggggaacggttttaaacnggtaaccggtccgtcggttaaacggg

SEQ ID NO: 44536 - DNA, 912 bp, Homo sapiens
  misc_feature: GYAE6OF01A5CRU.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgcttgggtttccttgttgctattttagaaggtgtccaatgtgaggtgcagctggtggagtcgtgggggaggtcgttgggttcaggtccgtcggggggtccctggacgactctcctgtgccagtcctcgttggtacttttaccttcgtagttacctttaagttcgggtctaacgttaggaaaccggtttcgggggtacccgacccgaacgggtcccgttaccgggaacggggggtaacggggtcgttacggccggtagggtttaccggggttttaccaacgtaaccgttaagtttaaaccgttaacggtacgggtaaaacgggttaaccgggaacccttaaaacgtttaaaccgttaaccaacgtaacggtaccgttaccggttagggtaacgggaaccggggtaacccgttaacgtttccccgaaacccccgttaacccgttaccggaaacgggtaacccggaaacccggttaaccccggaaacccgtaaaaacggaaccctttacccggtaaccgtttaccgtttacccgttaccgtacgggaaaccttaaaaacgtacccggtaaaacgtacccggtaccgttaacgggaaccgggtaacggttaccgggaaaggtaaccccgggtaacggttccgtttaagggtacgttttaaaccggttaccgttagggtaacccgggcggggtaaacgtaacggggtcccgggttaaaccggggtaacgggggtacttaacgggtaccggtacgtaaaggttccccgggg

SEQ ID NO: 44537 - DNA, 659 bp, Homo sapiens
  misc_feature: GYAE6OF01CN3SP.7.85.H08.1.454.CMB.1.raw
  modified_base (181)..(181): a, c, t, g, unknown or other
  misc_feature (181)..(181): n is a, c, g, or t
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcttgggttttccttgttgcttattttagaaggtntccaatgtgaggtgctagcgtggtggagtcgtgggggagtcgttggttcacggccggtcggggggtccctgacgtaccttctccgtgtcgcctacgcctgtacggtatttacccgttactaagttacttagtgactatgtaacgttcgggtccgaccgacggcctaccggaggggacggtcgtacgcgtaggttcggttacaacgtactagttaactacgtaggtaacgtagtacctaattaacgtactaacgactagtcgtagtaggtaacgggtcctacttcccgacccgaccgtcccaagtacgaccgaaccgaccgaagtaaccactaccgtcgttaccgtntacgaactaaancgtaacacgtaccgtagacgacggtacgacgaccgtacggtactgtacgtagttacgtggtacgacgggaacgtggtaaccggtaccgggacgggtacttagaccgtaccgtagttccgg

SEQ ID NO: 44538 - DNA, 840 bp, Homo sapiens
  misc_feature: GYAE6OF01ADQ0L.7.85.H08.1.454.CMB.1.raw
  modified_base (265)..(265): a, c, t, g, unknown or other
  misc_feature (265)..(265): n is a, c, g, or t
tcagcgtgtctctacacgaccggtgctcgatttagtatcactcagtcggcgggggctctcagagaggtgccttagccctggattccaaggctatttccacttggtgatcagccactgaacacgagaggactcaccagtggaggttgggctgtgtcgtttcggttttccgttggttgtactttaagttttaaggaagggttcgttacctaagttggtggtagggtagcgaggtcggttggggtgggtacggttcgggtaggggggnggttcgtttgggttcgtacggtcccggggtcgggggtccctggtacgtaccgttccgttcgtgtcgcgtccgtccgtgtacgttacttttaccttacgtacgttacgttagtcggactacgtacgtaccggttccgggcccgaccggaccggtccggtaaccgggaggggtacgggtcgtacgggtcggtacgggtttcggttaccaacgttaacttaagtaaacggttacggtacggtaacggtacgtaactaacgttaacctaacgaagtaccgtacttacggtaggtaaccggacgggtactacccgtacctaacgtaccgttccgaacccggaaccggaaacctaacccggaagtaaccgtaacgttaccgtaaaggttcctaaacgttaaccaaacgttaacggtaaccgtaacggcccgttaaccgggaggtaacccgggaccgtaaccggggacccggtaaccggtcccgggtaaacgttgttacgttaggttgtaacggttacgaggtaacggttaccggtacggttccgtagttacgttaaggtacgtaagttacgggtcgttacg

SEQ ID NO: 44539 - DNA, 625 bp, Homo sapiens
  misc_feature: GYAE6OF01CNUKP.7.85.H08.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (494)..(494): a, c, t, g, unknown or other
  misc_feature (494)..(494): n is a, c, g, or t
  modified_base (561)..(561): a, c, t, g, unknown or other
  misc_feature (561)..(561): n is a, c, g, or t
tcagcgtgtctctacacgaccggtgctcgatttagtatcactcagtcggcgggggctctcagagaggtgccttacgccctggattccaaaggcatttccacttggtgatcagcactgaacacagaggactcaccatggagttggggctgtgcttgggttttccttgttgctattttagagtgtcaatgtgaggtgcagctggtggagtcgtggggaggtcttggttcgagccgtggggggtccctaggagactctcctgtgctagccttgnggtatttaccttanattacttatggcatgaacgtcgggtccncaggcctccgaggggaagggctggacgtagtcgggttcacacgtattaactagtcggaaacgtaggaccaattaacctacacgagtactcgtaggtagaacgggcgtacttaccgacccgtaaccctcgaacggtaaccgacgaaccgaacccgtaagaacctcgtactagtccttcgtanacctaaaatcgggaaacacgccgttaagagacgttaccggagtaccacggtctggttacatttacgnggtagacggaacgtagaccggtaccggggtaacggggtacttaggtacaacccgtgttacccgg

SEQ ID NO: 44540 - DNA, 798 bp, Homo sapiens
  misc_feature: GYAE6OF01ET1PM.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccagtggaggttggggctgtgcttgggttttcctgttgctattttagaagtgtcatgtgaggtgcagcgtggtggagtcggtgggggagtcgttggttcgacggtccggtcggggggtccctggacgtaccgtctcccgtggtcgccgacgtcccttcgttacggttaacttttacccgtttcgtaaggttaacgtttacgtggtacctaacgttaggaaccggttcggggtaccccgaccgtaacgggccgtaaccggagggggaacgggtcgtcggacgtaggtttcgggttaccacgtaactaacgtttaaagtacgtaagggtaacggtaacggtaacctaaattaacccgtttacgaacgtaacgtacctttcgttcgggtaacggacgggtaccgttaacgttacccgaaccccgtacctccggaaacggtacgaacccgtaaccggtaaacccgtaaacgtaaccgttaccgtaacgttccgtttaccgtcctacgtaaacctaaagaccgtaaacgacgtaccggttaggaaccgttaacgggtacgaacgggtaacgtaccggtacgtagttaacggttactttaccggtggttaccggtaacgggagtaacgggttacgcgggggtaaacggtacgttaggaccgtacgtacgtacggg

SEQ ID NO: 44541 - DNA, 838 bp, Homo sapiens
  misc_feature: GYAE6OF01CPGY0.7.85.H08.1.454.CMB.1.raw
  modified_base (588)..(588): a, c, t, g, unknown or other
  misc_feature (588)..(588): n is a, c, g, or t
tcagcgtgtctctacacgaccggtgctcgatttagtatcactcagtcggcgggggctctcagagaggtgccttagccctggattccaaggcatttccacttggtgatcagcactgaacacagaggactcaccatggaggttgggctggtgtcgttcgggttttccttggttgtactttaagtttttaaggaaggttgtaccctaaagttggttacggtaagggtgaccgtaggtccgttggggttcgggaaggtttcgggagggggggtacgttcgttttgggttccgtaggtcccgggttccgggggggtccctaggaaccggtaccttcgtccgtggtcgacgtcgtcccttgtacggttaacttttaccgtacacggtttaattagcggtactaggtacgtaacggtcggtccacgtacgccgtacgggaggggtacgggtctagggtacgtacgggtttacggttacaaccgtaacgtttaacgttaaacgttacggtaacgggtaaacgtaacggaacctaaagtttaacccgttaacgaacgtaagtacccgtttagttacggaacgggaaccgggtacctnttaacccgaacccttcccgaacgtaacgaacggtaacctaccggaaaccttaacggaaccttccgtacgttacggtaccttagaccgtaaagtaactcggaaactcggaacctagggacgtacgacggacgaaccggttcgagtttacgtacgttaaagttccgtgggacccggttaagaaccgggtaacggtaccggggtaccgggggtaacggacgttttaagacccgggtacttaacgggtacccgg

SEQ ID NO: 44542 - DNA, 794 bp, Homo sapiens
  misc_feature: GYAE6OF01C4ZA8.7.85.H08.1.454.CMB.1.raw
  modified_base (264)..(264): a, c, t, g, unknown or other
  misc_feature (264)..(264): n is a, c, g, or t
tcagcgtgtctctacacgaccggtgctcgatttagtatcactcagtcgcgggggctctcagagaggtgccttagacctggattccaaggcattttccactttggtgatcagcactgaacacagaggactcaccatggagttggggctgtgcttgggttttccttgttgtcttattttagaaggtgtccaatggtgaggtgcagctgggtggagtcgtgggggagtcgttggtcagccggtgggggtccctgagtctctcctgtncacgtcctcgtggtacttttaccttactaagttacttagtggacagtacggtaaccgtcgggttaccccgaccgtacggtccgtaaccgggaacgggggtaacggggcgtaggaaccgttagggttcgggttttaaccaactaacttaaagtttaacgttaaccggttaggaaaaggttacgtaaccgtaaaatttaaaccgttaacgaacgaacgttaacttacgtaggtacggaaaccggggtacctaacttacccgaacccctaaccgtaccaacgggaacgaacccgaacgaacccgtaaacgaacctaccgtaaccgttcttacgtaccgtacaaccgttaaacgttcgaaaaccacggttacccgtaggtaacgtaaccggttacggtaaccggacgtaaccgggttacggttagttaacggtttaaattacggttagtacggtaccggtaaagggtaccggtaacgggttaacccgggggtaaggggtaacttaaggtaaaccggacgttaaccggttaacgg

SEQ ID NO: 44543 - DNA, 831 bp, Homo sapiens
  misc_feature: GYAE6OF01ASPFF.7.85.H08.1.454.CMB.1.raw
tcagcgtgtctctacacgaccggtgctcgatttagtatcactcagtcgcggggctctcagagaggtgccttagccctggattccaaggcatttccacttggtgatcagcactgaacacgagaggactcaccatggagttgggctgtgcttggttttcttgttgctatttagagtgtccaatgtgagtgcagcgtggtggacgtacggtggggaggtcgtttcggtcgacggtccggtcggggggtccctagacgcttcgtccgtgtcgtcacgtccgttcgtcggttactttcccgtagtacgttacttagtcgactagtacgtacggttccgggtccgccgtacggtctaccggaaggggtaacgggtcgtcggccgttaggtttccggggttaactaccgtaacgttaacgtttaaacgtaacggtaacgggtaaacgtaaacggtaaaccctaaccgtttaaaactaccgacgtaaacggtaccttaggtcggtaaacgggtaccgggtaacccgttaccgttacccgaacccgttaaccccgtaacgtaccggaaacggtaacccgaaccgaaccgtaaaccggtaacctacccgtacgtcccgtactacgtaacggtactaaagttaacgaacccgtaagtacccgtaagggtaacgttaaccgggtaggaacccgtaacggtacccggtggttaacggttccgtttaacgggttaaccgtttcgggaactaacccggggtagtaaacgggtaccccgggttaacccgggtaagggggttaccccgtaaggtttacccgggaaaccgttaaggtttaaaccccggg

SEQ ID NO: 44544 - DNA, 822 bp, Homo sapiens
  misc_feature: GYAE6OF01CMI94.7.85.H08.1.454.CMB.1.raw
  modified_base (630)..(630): a, c, t, g, unknown or other
  misc_feature (630)..(630): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccagtggagttgggctgtgcgttgggttttccttgttgtcttagttttaaggaaggtgtaccaagttgtaggaggtgcgagcgtgggtggagtcggtgggggaggtcgtttggttcgacggtccgggttcggggggtccccttggacgtacccgttcgttcccgttggttcgaccgtaccgtcccttacgttacggttaaccttttacccgttacgtaacgtttacttagtacggtactagtacggtaaccggtcgggtcccgacgtacggtacccgtacgggaagggggacgggtccgtaggtacgtagggtttcggttacaactaacttaagttaacgtacggtaggtaaacggtaacgtaacctaaacttaaccgtacgaactacgtaaccgtgtacggtacggacggtaccgtacctacccgaccctacgaccgaaaggaaccgacccggaaccgaaaccgtaaacgtaccctacgttaccgttacgtcccgttaanacggaaactaaacggtacgaaaccgaccggtaccgtaagggtaccggtaacgggtaccgggaaaccggtccggtaacgggttagtttacgtaacggtttaccggtttaacggacgggttacgacgggaagtaaaccggggtcgtaaaccgggggtgggtaaaccttgaccccggtaacgtcgggttaaccgg

SEQ ID NO: 44545 - DNA, 781 bp, Homo sapiens
  misc_feature: GYAE6OF01DAODM.7.85.H08.1.454.CMB.1.raw
  modified_base (624)..(624): a, c, t, g, unknown or other
  misc_feature (624)..(624): n is a, c, g, or t
tcagcgtgtctctacacgaccggtgctcgatttagtatcactcagtcgcgggggctctcagagaggtgccttagccctggattccaaggcatttccacttggtgatcagcactgaacacagagactcaccatggagttgggctgtgtcttgggttttccttgtgtcttattttagaaggtgtccaatgtgaggtgcagcgtggtggagttcggtggggagtcgtttggttcacggtccggtcgggggtccctgacgtctctccgtgtgcacgtccttcgtggttaaccttttaccttacgtaacgttaaccgtttagtacggtacctagttcgtaaacggttccgggttaccggacccgtaagggtcccgttaacccgggaacgggggtaaagggtccgttagggacccgttagggttaccggttaccaacggtaacttaagtttaaacgttaaccggttaaggaaaacgggttaccggaaccttaaacttaaacgtacctaaacgacgtacgtacgttaggtacggaacgggtcctaagttcccaaccctaaccctaccgaacgaacgtaccgaaccgaaccaacgaacctctacgtcgtcttacacgaactaagtacgaacnccgtaccgtaagacggtaaggtaccgaacggtacggacggttccggttacgttacggttaacgttacgttggtacccggacgggtagtaaaaccgggtccggttaaccgggggaaaggggtttaacctaaggtcccggaaacgttccgggttacggg

SEQ ID NO: 44546 - DNA, 761 bp, Homo sapiens
  misc_feature: GYAE6OF01BIP0A.7.85.H08.1.454.CMB.1.raw
  modified_base (551)..(551): a, c, t, g, unknown or other
  misc_feature (551)..(551): n is a, c, g, or t
  modified_base (581)..(581): a, c, t, g, unknown or other
  misc_feature (581)..(581): n is a, c, g, or t
tcagcgtgtctctacacgaccggtgctcgatttagtatcactcagtcggcgggggctctcagagaggtgccttagccctggattccaaggcatttccacttggtgatcagcactgaacacagaggactcaccagtggagttggggctggtgcgttgggttttccttgttgcttattttagaaggtgtccaagtgtgaggtgcagtcgtgggtggtagtcggtgggggagtcgttggttcagccggtgggggtccctgagtactctctgtgccgacgtcctgtcggttaactttaccttagtaacgttacctttagcgtaccgtagtagtaaccggtcgggtcccgacgacggcgtaccggaagggacgggcttacggacgttagggtcgttacaactactaagtaaacgtagtaaggtaaggtaaccgtaacctattaaacctaacgtacgaagtaacccttggttaagggcggtaaacgggtccctaagttacccaaaccccggtactaacggaaacgacggaaaccgcctaaaccccggaaattacccnccggtaaccttgggtaacccctttacgganaaacccgtaaagttaacgaaaccgtcccgtaagtaccgggtaaggtccgtaaaccggggtaacggaaccgttaccgggttgtaaaccgtttacgttaagtaacccggtggtacggaacggaaggacgggtaacgggccgggtaaggggaaccctttaaggaccgaaggttcgtaaccggg

SEQ ID NO: 44547 - DNA, 835 bp, Homo sapiens
  misc_feature: GYAE6OF01ANIZM.7.85.H08.1.454.CMB.1.raw
  modified_base (127)..(127): a, c, t, g, unknown or other
  misc_feature (127)..(127): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggacncaccatggaggttgggctgtgtcgttgggttttccttgttgcttagtttagaggtgtaccaagtgtgaggtgcgagcgttgggtggtagtcggtagggggacggtcgttggttcacggtccggtgggggtccctggacgtacctccgtcgtgtcgccgtacgtcctacggttacggtacttttaccgttacgtattaacgttagtcggtaactacgtacggtaaccggttccggggtaccccgaccgtaccggacggtaccgggaacgggggtaacgggtccgtagggtacgttacggggttcggttaaccacgtaacgttaactttaaacgtaacggtacgggtaaacgtaacggtaacccttaaacgtttaaacccgtaacgaactaaccggtacgttacggtagggtaaccgggtacgggtacccgttaacgtaccctacccgtacctaccggaacggtacgaaccggtaaccaaccgttaagaacccgttctaaccgttcgttacccacgttaacgaacgtaacgaaccgaacctaccggtacgtaacgggtaacgggtacgtaaccgggtacggtaaccgggtcgtaacggttgttaccgtttaaggttaccggtgttaacgggacggtaacggtacggtaacccgggtacgggggtaaacggtaacccggtaggtaaacgtccggttaacgggttaacccgg

SEQ ID NO: 44548 - DNA, 876 bp, Homo sapiens
  misc_feature: GYAE6OF01BGB20.7.85.H08.1.454.CMB.1.raw
tcagcgtgtctctacacgaccggtgctcgatttagtatcactcagtcgcgggggctctcagagaggtgccttagccctggattccaaggcatttccacttggtgatcgagcactgaacacaggtaggactcgaacctagtcggtagttggggactggtcggtcgttgggtttttccttagttcgtcgttagttttaggaaggttcggtaccgtaatggtgagggtcgaccgaggtcggtgggtaggggcgttcgggtaggggggaacgtccgtttcgggttaaccgcgggttacccgggttcgggggggtacccctagggaccgttaccgttcccttccggttggtccgtaaccggtaccgttccgttacggttacgtttaccttttaccgtacgttacgttacgttaggcgtactacggttacggtaacgggtccggtacccggacgtacggtaccgaccggggtaaggggtaaccggtccgtacggttaggttacggtttaccgtaactaacgtaacgtttacgttaaacggtacggtaaaggttaacgacccgtaaacctaacgttaaacctaccgtaacggtaccgtacgttcggtacgggtaacgggtaccggttacctaccgttaacccgaacccgttaccgtaaaccgacgggaaccgaaccggtaacgaaccgtaacgtaaccgttacgtaccgttacggtacgttaacgacgaataacggtaacgtaaccgtaacgtaccggacggtaacggaacggtaccgtacggaccgtggttacgtagtttcgtaggttacggtcggtaggtacggtaggtaacggtccgggtaaggggtaccgttacgtaccgtacgacggtacggtaccgg

SEQ ID NO: 44549 - DNA, 511 bp, Homo sapiens
  misc_feature: GYAE6OF02GE5U3.7.85.H08.1.454.CMB.1.raw
tcagcgtgtctctacacgaccggtgctcgatttagtatcactcagtcgcggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccactccagagacgacgccaagaactcactgtctctgcaaatgaacagcctgagagtcgaggacacggctgtgtattacgtgtgcgagagagtccggaggggaccgtatcggaccatcg

SEQ ID NO: 44550 - DNA, 532 bp, Homo sapiens
  misc_feature: GYAE6OF02I7F53.7.85.H08.1.454.CMB.1.raw
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccgagggaaggggctggcaggttgggttcacacattaatactaggaagtaggaccataacttacacagactctagtgaaggccgattcaccacctccagagacgacgccaagaactcactgtctctgacaaatgaacacgcctagagagtcgagacacggctgtgtattacgnggtncggaagagtagtaccggggaggggtacctagtacgaccgtagtacgg

SEQ ID NO: 44551 - DNA, 516 bp, Homo sapiens
  misc_feature: GYAE6OF02G46ZS.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccgagggaaggggctgcagtgggtttcacacattaatactggaagtaggaccataacttacacagactctgtgaaggccgattcaccacctccagagacgacgaccaagacctcactgtctctgacaatgaacagcctgagagtcgaggacacggctgtgtattacgtgtgcggagagagtccgggaggggtactagtcgaccatcgg

SEQ ID NO: 44552 - DNA, 512 bp, Homo sapiens
  misc_feature: GYAE6OF02H7MFZ.7.85.H08.1.454.CMB.1.raw
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttccttgttgctattttagaggtgtcaatgtgaggtgcagctggtggagtctgggggagcttggttcagcctggggggtccctgagactctcctgtgcagcctctggatttacttcagtacttatggcatgaactggtccgcaggctccaggagggctgcagtgggttcacacattaatactggaagtaggaccataacttacncaagactctgtgaaggccgattcacacctcaganacgacgcaagaactcaactgtactctgacaaatgaaacagcctagagagtcgaggacaacgctagtgtattacgtgtgacgagtagacgtacgggagggtacgtagtcgaccgtatacgg

SEQ ID NO: 44553 - DNA, 598 bp, Homo sapiens
  misc_feature: GYAE6OF02J1NO5.7.85.H08.1.454.CMB.1.raw
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
  modified_base (475)..(475): a, c, t, g, unknown or other
  misc_feature (475)..(475): n is a, c, g, or t
  modified_base (539)..(539): a, c, t, g, unknown or other
  misc_feature (539)..(539): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttccttgttgtctatttagtaggtgtccaatgtgaggtgcagctggtgggagtcgtgggggagggcgttggttcgtagccgtcggggggttcccggtgaggacgtcctccttgtgcacgccgtctggtatttaccttcagtacttagttggcatgaacgtcggtcgccnggctccgaggggaggggcgtgcgnggtgggtttcacacaattaatacgtggaagtaacggaccaataacttaacgacacgtactcttggagaacgggcgtacttcacccgacctcgacgagaccgacgaaccagaactactcctgttctacntacaaactgaactacgcctagaagacgtaccgacggaacgcggtacctgttcgtaaggtttacnggttgacgaaggtacgtaaggtcccggggaaggggtccgtaagtacgaccgtagtacgg

SEQ ID NO: 44554 - DNA, 523 bp, Homo sapiens
  misc_feature: GYAE6OF02HTJ23.7.85.H08.1.454.CMB.1.raw
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggagcttggttcagcctggggggtccctgagactctcctgtgcagcctctggatttacctcagtacttatggcatgaactgggtccgcaggctccgagggaagggctgcaggtgggtttcactacattaatacgtggaagttaggaccaataaacttacacagactctgtagagggcctattccgaccacctccagagacgacgccaagaactcaactgtctctgacaatgaaacngcctgagagtcgaaggacncggntgtnttatacgtgngcgagagcgtccgggagggaccgtagcgtaccagtcgg

SEQ ID NO: 44555 - DNA, 510 bp, Homo sapiens
  misc_feature: GYAE6OF02GE72K.7.85.H08.1.454.CMB.1.raw
  modified_base (438)..(438): a, c, t, g, unknown or other
  misc_feature (438)..(438): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagccgtggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccattcacacatccagagacgacgccaagactcactgtctctgcaaatgaacngcctgagagtcgaggacacggctgtgtattctgtgcgagagacgtccgggagggtacgtagtcgacctacgg

SEQ ID NO: 44556 - DNA, 538 bp, Homo sapiens
  misc_feature: GYAE6OF02HFVKO.7.85.H08.1.454.CMB.1.raw
  modified_base (444)..(444): a, c, t, g, unknown or other
  misc_feature (444)..(444): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctatttagaaggtgtccaatgtgaggtgcagctggtggagtcgtgggggaggcttggttcaggccgtggggggtccctgagactctcctgtgcagcctctggtattttaccttcagtacttatggcatgaactgggtccgccaggctccgagggagggctgcaggtgggttcacacattaatactaggaagtaggacctaataacttacacagactcgtgtagaagggccattccaacccacctccagacgacgacgaccaaagaactcaactgtcctntagacaaatgaaacagcctagagagtcgaggaacncgggntgtagtattcgtgtagcgaagagacgtccgggagggtacctagtgaccagtacg

SEQ ID NO: 44557 - DNA, 668 bp, Homo sapiens
  misc_feature: GYAE6OF02J25EK.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggagcttgggttcaggccgtgggggggtccctggacgactctcctgtgcagcctctggtatttaccttcagttacttatggctatgaactgggtccgcgaggctccgaggggacgggctgcgaggttgggttcacactattaatacgtaggaagtaggacctaattaactacacacgactcgtgtaggaacgggctattaccgaccctacctacccgaaggacgtaaccggaccgtacccgaaaggtaacctccgaacttccggttaccttaccgacgttaaccaaacgttaacgaaaccgaggtacccgttaggaaacggtacgttaaccggggacgggtaaacccgacgggggttcttaggttacgttaacgtttacgtcgggtagaccggtaaggtacggtacggtaccgggggtaacggggacctttaacggcggtaaccgtaggttacgg

SEQ ID NO: 44558 - DNA, 530 bp, Homo sapiens
  misc_feature: GYAE6OF02IC0Y1.7.85.H08.1.454.CMB.1.raw
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctatttttagaaggtgtccaatgtgaggtgcagctggtggagtctgggggaggcttggttcagcctggggggtccctgagactctcctgtgcagcctctggattttaccttcagtacttatggcatgaactgggtccgccaggctccgaggggaagggctgcgagtgggtttcacacattaatacgtggaagtaggaccattaacttacacanactctgtgaacggctatcaccacctccagacacgacgaccaagactcactgctctgacaaatgaacngacctgagagtcgaaggacacggntgtagtattacgngtagcggtaagagcggtccgggaaggggaccttagtcgacctagtcgg

SEQ ID NO: 44559 - DNA, 644 bp, Homo sapiens
  misc_feature: GYAE6OF02H0352.7.85.H08.1.454.CMB.1.raw
tcagcgtgtctctacacgaccggtgctcgatttagtatcactcagtcgcgggggcgtctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcgttgggttcaggccgtgggggggtccctggagactctcctgtgcagcctctggactttacctctagttacttatggcatgaactggtccgccaggctccgagggaacgggctgcgagtcgggtttcacgactattaaatacgtaggaagtaggacctaataaacttaactacaagactcgtagtaggaacggggcctaattacccacctaacccctcgaagacgacgaaccgaccaaaggaactacaactcgtctaccgtgacaaaagtcgaaaaccgtacgaccgtaggaagtacggtacgaacgggtaaccgaacgggtcgtaggtacggtttaagttaccgtggttaccgacggtaaggtaacggaacggttacccgggggaagggggtaaccgttaaggtacgtaacccgaggttaccgg

SEQ ID NO: 44560 - DNA, 661 bp, Homo sapiens
  misc_feature: GYAE6OF02I2IS5.7.85.H08.1.454.CMB.1.raw
  modified_base (310)..(310): a, c, t, g, unknown or other
  misc_feature (310)..(310): n is a, c, g, or t
tcagcgtgtctctacacgaccggtgctcgatttagtatcactcagtcgcggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctggggaggcttggttcagccgtgggggtccctgagactctcctgtgcagcctctggtacttttaccttcaaggttactttatgggctagtgaactggggtccnccgaggcctccgaagggacggggctggctaggttgggtttcacgtacaagtttaatacgaggtaaagtacggaacctattaaacgttacaacacgtacttcgtaggtagaaacggggtcctagtttaccaaccctaaccgtaccgaacggagtaaccggacgacccgaaacggtaaacctaccgtaacgttcgtaccttacctacgactaaaacgtacgaaacgtacgaccgtacgaagtaacggttaccggaaggaccgtaaccgggattaccggtagtttaactaccgttggtacgccggtaagacggagttaccgggagggtaacggttagtacggacgtacgtacgg

SEQ ID NO: 44561 - DNA, 524 bp, Homo sapiens
  misc_feature: GYAE6OF02FWMRC.7.85.H08.1.454.CMB.1.raw
  modified_base (437)..(437): a, c, t, g, unknown or other
  misc_feature (437)..(437): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgcaggctccgagggagggctgcagtgggttcacacattaatactggaagtaggaccaataacttacaacagactctgtgaagggcattcacctacctcagagacgacgaccaagacctcactgtctctgacctaaancgaacagcctagagagtcgaggacacggctgtgtattacgtggtgacggagagacgtccgggaggggtacgtatcgacctagtacgg

SEQ ID NO: 44562 - DNA, 585 bp, Homo sapiens
  misc_feature: GYAE6OF02HW5GB.7.85.H08.1.454.CMB.1.raw
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctggttttccttgttgctattttagagtgtccaatgtgaggtgcagctggtggagtcgtgggggaggtcttggttcagccgtggggggtccctgagactctcctgtgcagcctcgtggtattttacctcagttacttatggcatgaacgtcgggtcccgccgaggcgtaccgaggggaaggggctgcaggttgggttcacacattaatacgtggaagtacgacctaataacttacactagacttcgtagtggaacgggcattccaccacctcagagacgaccgaccaaagactcacttgtacctcagacaaatgaaacagcctaggagtacgtacgaaggaccaaccgggtnttcggttagttaagttaccgnggtacgtacggaagtaggaccggttaccggggaaggggtacttaaggtacgacctagttaccgg

SEQ ID NO: 44563 - DNA, 529 bp, Homo sapiens
  misc_feature: GYAE6OF02JGU8X.7.85.H08.1.454.CMB.1.raw
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagcctgggggggtccctgagactctcctgtgcagcctctggatttaccttcagtacttatggcatgaactgggtccgccgaggcctccgaggggaacggggctgcaggtgggtttcactactattaatacgtggaagtaggaccataacttacacagactctgtggaagggccattccacccacctcagagacgacgaccaagactcactgtctctgacaaatgaaacngcctagagacgtcgaggacacggntgtgtatcgtgtagcgagagcgtaccgggagggtactagtcgactagtcg

SEQ ID NO: 44564 - DNA, 575 bp, Homo sapiens
  misc_feature: GYAE6OF02HYVNV.7.85.H08.1.454.CMB.1.raw
  modified_base (429)..(429): a, c, t, g, unknown or other
  misc_feature (429)..(429): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttgggttcagccgtggggggtccctggagactctcctgtgcagcctctggatttacctcagtacttatggcatgaactgggtccgccaggctccgaggggaacggggctggcaggttcgggtttcacacatttaatacgtaggtaaagtaggaccaataacttacaacagtactctgtagaacgggccatccaccacctcagagacgacnccaagactcactgtctctagacaaatcgaacacgcctagacgaggtacgaggacaccgggctaggttagtaactttacgtggttacggcggaaggacgtacggttacccggggaagggggtaccttaagtcggacctagttaacgg

SEQ ID NO: 44565 - DNA, 564 bp, Homo sapiens
  misc_feature: GYAE6OF02HW4XN.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggagcttggttcagccgtgggggtccctgagactctcctgtgcagcctctggattttaccttcagtacttatggcatgaactgggtccgccgaggcctccgaggggacgggctgctaggtgggtttcacacatttaatacgtaggaagtaggaccaataacttacacagtactcgtagtacgaacgggaccgtattaccacctaccaccgtttacgacgacgacgacgaacgaactacactcgtctactcgacaaatagaacacgcctagagacgtacgaggacgacgctagtagttattacgtgtcgacgtagagacgtacgggacgggtacgtagtacgacgagtacgg

SEQ ID NO: 44566 - DNA, 754 bp, Homo sapiens
  misc_feature: GYAE6OF02IPAK5.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggtttctttcgttgtctatttagttaaggtagttcgtactagtgaggtgtcagacgtggtgggaggtacgtggggagggcgttcggtttcgtacgaccgtcgggggttccggtcgtagacgtctccgttcgtggtcacgccgttccttcggtagttttacctttcctagtacgtttaattggcgtatgtaacgtacgggtccggcccacggcgtccacgggaaggggacgtgcgagttagggtttcgtacactattaacgtaacgtggtaaggtaacgtaccgaacttaactttaacactaacgtaacgtccgttaggtaggaacgggacccggtacttaccttaaacccgaaccctcccgtaacggaacgaaccggtaaccgaacccgaaacgtaaacctactaacctcgttccgtttcctacgacctaaaacgtagaaacccgagtacccgtacgaaggtaacggttacggaacgggtaaacgaccggtaccggttgttaggtttaacgtttaaccgtttcgggcggtaaccggaaggtaaacggtagggtttaccccggggaagggggttacggtaacgttacgacccgtaagtttacgg

SEQ ID NO: 44567 - DNA, 523 bp, Homo sapiens
  misc_feature: GYAE6OF02FQILB.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttgggttcagcctggggggtccctgagactctcctgtgcagcctctggatttaccttcagtacttatggcatgaactgggtccgccaggctccagggaaggggctgcagtgggttttcacacgattaatactggaagtaggaccataaacttacacagactctgtgaagggccgattcaccacctccagagacgacgaccaagaactcactgtctctgcaaatcgaacagcctgagagtcgaggacacggctgtgtattacgtgtgacggagagatccgggaggggacgtagtcggaccatacgg

SEQ ID NO: 44568 - DNA, 558 bp, Homo sapiens
  misc_feature: GYAE6OF02GQUY3.7.85.H08.1.454.CMB.1.raw
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (518)..(518): a, c, t, g, unknown or other
  misc_feature (518)..(518): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggtattttaccttcagttacttatggctatgaacgttcgggtcccgccgaggcctccggaaggggaacggggctgcgtaggtgggtttcacgactattaatacgtaggaagtacggaacctaataacttacaacagtactctgtagaacgggccattccacccacctccaagacgacgacgaccaagaactcactgtctcngacaagtgaacngcctagagagtcgacgacacggtntgtntacgttacgtgngcgagacgacggtacgggagggactagcgaccagtaccgg

SEQ ID NO: 44569 - DNA, 548 bp, Homo sapiens
  misc_feature: GYAE6OF02IFDWU.7.85.H08.1.454.CMB.1.raw
  modified_base (542)..(542): a, c, t, g, unknown or other
  misc_feature (542)..(542): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggtttttcctgttgctatttttagaaggtgtccaatgtgaggtgcagctggtggagtcgtgggggagcttggttcagccgtgggggtccctgagactctcctgtgcagcctctggattttaccttcagtacttatggcatgaactgggtccgccaggctccgagggagggctgcagtggtttcacacattaatacgtggaagtaggaccaattaacttacacagactctgtagaagggccgattccacccacctcaagacgacgaccgaccgaaagacctaccaacgttcgtcctctgacaaaatgaaacaggcctagagacgtcgaggacacggctggtacttattacgtggtagcgagacgtacggtcgggaggggtactagtcgaccngtacgg

SEQ ID NO: 44570 - DNA, 540 bp, Homo sapiens
  misc_feature: GYAE6OF02GYWO4.7.85.H08.1.454.CMB.1.raw
  modified_base (304)..(304): a, c, t, g, unknown or other
  misc_feature (304)..(304): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttgggttcagcctgggggggtccctgagactctcctgtgcagcctctggatttaccttcagtacttatggcatgaactgggtccncaggctccgagggagggctgcagtgggttcacacattaatactggaagtaggaccataacttacacagactctgtgaagggccgattcaccacctcagagacgacgccaagactcactgtctctgacaaatcgaaacagcctagagtacgtcgaaggacacgggctggtgttattacgtggttcgcgaaggagtacgtcccggggaggggtaccttaggtcggaaccagttaccgg

SEQ ID NO: 44571 - DNA, 696 bp, Homo sapiens
  misc_feature: GYAE6OF02IKPZF.7.85.H08.1.454.CMB.1.raw
  modified_base (601)..(601): a, c, t, g, unknown or other
  misc_feature (601)..(601): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgtgctattttagaaggtgtccaatgtgaggtgcagctggtggagtcgtgggggaggtcgtttgggttcaggtccgttgggggggtcccctggagactctcctgtgcacgtcctcgtggtacttttaccttcagttacttagtggctatacgaacgtcggggtcccgccgaggtccttacggaaggggacggggtctggacgtaggttgggtttaccacgtactaagtttaaactacgtagggtaaacgtacggaacctaagttaaacttaacacaagtaccttcgttaggtagggtaacgggtaccgtaacttccgaaccctacctaccgaaggaacgaaccgaaccgacccaaacgtaacctcctaacttcgtactcctagaactaaagtacgaaccgacgtccgtaggaacgacggtaccgaacgggtaccaccgggtnttacggtagttatttaccggtagttcggacgtaaggtaacggtacggttaccgggggaacgggttaccgtaaggtacggaacccgtagttaccgg

SEQ ID NO: 44572 - DNA, 541 bp, Homo sapiens
  misc_feature: GYAE6OF02INAHP.7.85.H08.1.454.CMB.1.raw
  modified_base (473)..(473): a, c, t, g, unknown or other
  misc_feature (473)..(473): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggatttacctcagtacttatggcatgaactgggtccgcaggctccgagggagggctgcagtgggtttcacacattaatacgtggaagtacggacctaataactacacagactctgtgaacgggcctattcaccacctccagacgacgacgccaaagactcactgtctctgacaaatcgaacagcctagagacgcgaaggacaccgggntaggtgtacttacgtgtcgacggtaagaggacgtccggggaggggtacgtagtcggacctaggtacgg

SEQ ID NO: 44573 - DNA, 521 bp, Homo sapiens
  misc_feature: GYAE6OF02HSNGF.7.85.H08.1.454.CMB.1.raw
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
  modified_base (478)..(478): a, c, t, g, unknown or other
  misc_feature (478)..(478): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggattttaccttcagtacttatggcatgaactgggtccgccaggctcgaggggagggctgcgagtggttcacacattaatactggaagtaggaccataactacacagactntgtgaacgggccgattccaccacctcagacgacgacgcaagactcactgctcngacaaatgaacagcctagagagtacgaggacacggctgtagtattacgnggtcgcgagagacgtacgggaggggtactagtcggactagtcg

SEQ ID NO: 44574 - DNA, 609 bp, Homo sapiens
  misc_feature: GYAE6OF02HU8RU.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagagtgtcaatgtgagtgcagctggtggagtcgtgggggaggcgttggttcaggccgtggggggtccctgagactctcctgtgcagcctctggatttaccttcagtacttatggcatgaacgtggtccgccgaggctccgagggaaggggctggctaggttcgggtttcacactaattaatactagggaagtaggaccaataacttacactagactctggtgaacgggccgtattccaccacctccagagacgacgaccaagaactcactgtctctagacaaatagaaaccgagtacccagtaacggacgtacggagggaccaacggtcgtacggttagttaacttttacggtacggttacggtcgggaaagtacgggacggttacccggggtaacggggggaaccgtttaacggtacggacccgtaagttaccggg

SEQ ID NO: 44575 - DNA, 572 bp, Homo sapiens
  misc_feature: GYAE6OF02HSTF0.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggattttaccttcagtacttatggcatgaactgggtccgccaggctccgaggggagggctgcaggtggttcacactattaatacgtggaagtaggacctaataactacacagactctgtagaagggccattccacccaccgtaccagacgacgacgaccaagaactcactgtctctagacaaatcgaacacgccgtagagtacgtacggaagggaccacggtcttaggtagttagttacgtggtacggacggtaagacggtacggtccggggaagggggtaccgttaaggtaccggacctagtacgg

SEQ ID NO: 44576 - DNA, 578 bp, Homo sapiens
  misc_feature: GYAE6OF02GLEQZ.7.85.H08.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctgggggggtccctgagactctcctgtgcagcctctggatttaccttcagtacttatggcatgaactgggtccnccaggctccaggaagggctgcagtgggtttcacanattaaanacnggaagtaggaccataaacttacatagactctgtcgaagggccgattcaccactccaganacgacgccaaagaacgtcaactgtactactgactaaatcgaaacacggaccttgaacgagtacgtaagggacaacgggtcctacggttgtaatttaaccgtggtacggtcgaacggtaacgagttacccggggaagggggtaaccgttagtacggtaaccccaagttaccgg

SEQ ID NO: 44577 - DNA, 507 bp, Homo sapiens
  misc_feature: GYAE6OF02HO8N1.7.85.H08.1.454.CMB.1.raw
  modified_base (430)..(430): a, c, t, g, unknown or other
  misc_feature (430)..(430): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgcaggctccgagggagggctgcagtgggtttcacatattaatactggaagtaggaccaagtaacttacacagtactctgtgaagggccgattccaccacctcagagacgacgcaagactcaactgtctcngacaaagtgaacagcctgagagtcgaggacacgctgtgtattactgngcgagagngtcggagggactagcgacatcg

SEQ ID NO: 44578 - DNA, 645 bp, Homo sapiens
  misc_feature: GYAE6OF02GWSMF.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgcaggctccgagggagggctgcagtgggtttcactacgattaatacgtggaagtaggaccaataacttacactacgtactctaggtgaaggggcccgtatttccgaaccctacccgttacccaagaacggtaccggaaccgacccgaaacgtaaccgttcgaacttcggtaccttacgtcgtacctaaaatcgaaaccacgtcccgtacgaggtacggttaccgaagggtacccgaacgggtcttaggtagttaacgtttaaccggtggtaccggtaccggtaggaacggtaacgtacccgggggtagggggtaaccttacggttacggaccctagttacccggg

SEQ ID NO: 44579 - DNA, 802 bp, Homo sapiens
  misc_feature: GYAE6OF02IN4OT.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggtttccttgttgctattttagaaggtgtccaatgtgaggtgcagctggtggagtcgtgggggaggtcgttggttcagtccgtgggggggtccctggagactctccgtgtgcagtcctcgtggtacttttacccttcaagttacctttagtgggcagttacggtaacgttcggggttcccgccgaacgggtccttacccggaagggggaacgggggtcctaggccggtaagggtttcggggttttaccaaaccgtaaccgtaagtttaaacgttaaccggttaaggggtaaacggttaacgggtaaccctaaagttaaaaccgtttaacgaaaccgtagtaaacccttcgttaggtaacgggtaacggggtacccgtaacgtttacccgaaccccgtaaccccgttacccgaaacgggtaaccggtaaaccgggaaccccggaacccgtaaaacggtaaacccgtttacctaaccgtttacggttaccctaccgttacggaaaccctaaaagttaacgaaaccgtacgtacccgtaggaacggtacggtaccgggaaacggaccgaacggtcgttacggtagtttaacttacggtggttaggaccgtaagacgtacggtcgggaagggtactagtacgtaccgagttaccgg

SEQ ID NO: 44580 - DNA, 632 bp, Homo sapiens
  misc_feature: GYAE6OF02ICRDN.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaaggtgtccaatgtgaggtgcagctggtggagtcgtgggggaggcttggttcagccgtggggggtccctgagactctcctgtgcagcctctggtatttaccttcagttacttatggcatgactgggtccgccaggcctccgagggaggggctgcgaggttcgggttcacactaattaatacgtaggaagtacggaccaattaaacttacaacagactctagtacggaacgggcctaattccacccacctacagaacgaccgacgacccaaagaacctcgtaactgttcctacgtagacctaaaagtcgaaaccacgtacccgtaaggaacggacgttaccgggaaggtaccgaccgggtctagttacggttacgtttaacgtggtacggacggaacgtacggtacggtacccggggtaagggggtacccgttaaggtacggaacccgagttaccggg

SEQ ID NO: 44581 - DNA, 553 bp, Homo sapiens
  misc_feature: GYAE6OF02F2WTS.7.85.H08.1.454.CMB.1.raw
  modified_base (442)..(442): a, c, t, g, unknown or other
  misc_feature (442)..(442): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgccgggttttccttgttgctattttagaaggtgtccaatgtgaggtgcagctggtggagtctgggggaggcttggttcagcctgggggtccctgagactctcctgtgcagcctctggatttaccttcagtacttatggcatgaactgggtccgccaggcctccgagggaaggggctgcaggtgggttcacacattaatactggaagtaggaccataacttacacagtactctgtagaacgggccatttcaccacctccaggagaacgaccgaccaaagaacctcaacttcgctcngacaaatcgaacagtcctggagtaggtcgaaggtacacggtctagttgtacttacgtggtcgcggtaggacgtagtaccggggagggacttagtcgacctagtacgtaccg

SEQ ID NO: 44582 - DNA, 747 bp, Homo sapiens
  misc_feature: GYAE6OF02IPSKH.7.85.H08.1.454.CMB.1.raw
tcagcgtgtctctacacgaccggtgctcgatttagtatcactcagtcgcgggggcgtctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcgtttggttcaggccgtgggggggttccctggagactcgtccctgtgcacgtcctctggtatttaccttcagtacttagtgacattgaactgggtccgccgaggcctccgaggggacgggctagcgtagggttggtttacgactaaccgtaattaacgtacgtaggtaaacggtacggaacctaattaaacctttaacgaaccgtaagaacctttacgtaggttacggaaaggggtacccggaatttccccgaaacctacccgttacccgaagacggtaaaccgacgggtaaacccaaacggtaaacccgttacaacgtttaccggttacttaccgtacggtaaacaaacgttacggaaaacccgttaacgcccggtttacggaagtaaccggttacggaaaccggggtaaacaaccccggtggttacttaggtaactttaccggtggttacgaccggtaagggtaaagtacccgggtaccggggtaacgggggtaccttaacgtacgggaaccctacgttaccggg

SEQ ID NO: 44583 - DNA, 530 bp, Homo sapiens
  misc_feature: GYAE6OF02FGV5X.7.85.H08.1.454.CMB.1.raw
  modified_base (303)..(303): a, c, t, g, unknown or other
  misc_feature (303)..(303): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagccgtggggggtccctgagactctcctgtgcagcctctggtatttaccttcagtacttatggcatgaactgggtccnccaggctccagggaaggggctgcaggtgggtttcacacattaatactggaagtaggaccataacttacacagactctgtagagggcgattcacccacctccagagacgacgccaagacctcactgtctctgacaaatgaacagcctgagagtcgagacacggctgtgtattacgtggtgacgaagagaacgtccggggaaggggtaccgttagcggaccagttacgg

SEQ ID NO: 44584 - DNA, 759 bp, Homo sapiens
  misc_feature: GYAE6OF02HBD03.7.85.H08.1.454.CMB.1.raw
tcagcgtgtctctacacgaccggtgctcgatttagtatcactcagtcgcggggcgtctcagagaggtgccttagccctggattccaaggcatttccacttggtgatcagcactgaacacagaggactcaccatggagttgggctgtgctgggtttcctgttgctattttagaaggtgtccaatgtgaggtgcagctggtggagtcgtgggggagcgtttgggttcaggtccgtcgggggggtccctggacgaccttcgttcctggtcgccgagtcctcgtcggtattttacccttacaggtttaacctttagttcgggctaagttcggaaacgttcggggtcccgtacccgaaggtccctaccggaaggggtaacggggccttggaccgttagggttggggtttccaaacgtactaagttaactacgtaggtaaaggttacggaaccctaaagttaaaccttaacaaccgaagtaaccttcgtaggttacggaaacggggtccctaagttaccaacccgtaaccctaccgaacgtacgaaaccgaccggaccaaaacgaaccttcgaaaccgtcggttacctactacggtaactaaaacgttacgaaaccgcgtaacccgtaggaaaggtaacgttacggaaacgggaaccgaaccgggttcctaggtttacgttaacgtttcgtaaggttacggacggtaaacgaggtaaccgtccgggggaagggtaacggttacgacgtaaccgtagttaacccgg

SEQ ID NO: 44585 - DNA, 718 bp, Homo sapiens
  misc_feature: GYAE6OF02GTFGU.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaggtgtccaatgtgaggtgcagctggtggagtctgggggaggcttggttcagccgtgggggtccctgagactctcctgtgcagcctctggatttaccttcagtacttatggcatgaacgtggggtccgccgaggcctccgaggggaacggggctggcgaggttggggtttccacgtactaatttaaactacgtagggaaagtacggacctaattaaacttaacaacaagtaccttcgtaggtacggaacgggcccgtaagtttcccaaccctacccttacccgaagacgtaaccgaaccgacccaaaggaacccttccaacgttcgtacccttacgtacgaacctaaacgtacggaaaccacggtaccccgtaggaaaggtaccggtaccggaacggggaacccgaaccggggtcgttacgggtttacgtttaacgtttacccggttggttacggtaccgggtaagggtaacggttaacggttacccggggggaacgggggttaaaccgttagggtaaccgtaacccggtaggtttaacccggg

SEQ ID NO: 44586 - DNA, 545 bp, Homo sapiens
  misc_feature: GYAE6OF02FXFAU.7.85.H08.1.454.CMB.1.raw
  modified_base (437)..(437): a, c, t, g, unknown or other
  misc_feature (437)..(437): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcttgggttcagccgtggggggtccctgagactctcctgtgcagcctctggtatttaccttcagtacttatggcatgaacgtgggtcccgccaggcctccgaggggaaggggctgcaggtgggtttcacacattaatacgtggaagtaggacctaataacttacaacagactctgtgaagggccattcaccacctcagagacgacgcaagaactcactntctctgacaaatgaaaccagcctagagtagtacgaacggacacggctagtgttacgttacgtggtagcggaagagtagtaccgggaggggtactagtagaccatacgg

SEQ ID NO: 44587 - DNA, 613 bp, Homo sapiens
  misc_feature: GYAE6OF02G8CYU.7.85.H08.1.454.CMB.1.raw
  modified_base (457)..(457): a, c, t, g, unknown or other
  misc_feature (457)..(457): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggtattttaccttcagttacttatggcatgaacgtgggtcccgccgaggcctccggaggggaacgggctgcgaggttcgggtttcacactattaatacgtaggtaagtacggaacctaataaacttacacagactctgtaggaacggccattccaccacctcagacgacgacgaccaagacctcactgtccnctacgactaaatcgaacagtaccctagaacgacgttacggaacggaccaaccgggtcttaggtagttaactttaccgtggtacgaacgggagtaacggtaacggttacccgggggaaggggtaacccgttacggtacggtaaccctaggttaccgg

SEQ ID NO: 44588 - DNA, 517 bp, Homo sapiens
  misc_feature: GYAE6OF02FK1DK.7.85.H08.1.454.CMB.1.raw
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
  modified_base (512)..(512): a, c, t, g, unknown or other
  misc_feature (512)..(512): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagccgtggggggtccctgagactctcctgtgcagcctctggtactttaccttcagttacttatggcatgaactgggtccgcaggctccgagggaagggctgcagtgggtttcacacattaanacgtaggaagtaggaccataacttacacagactctagtgaaggcattcacncctcagagacgacgcaagaactcacgtgtctcagacaaatgaacaggcctagagagtccgaggacncggctgtgtattacgtgngcgagagacgtcgggagggactagtcaccngtacg

SEQ ID NO: 44589 - DNA, 527 bp, Homo sapiens
  misc_feature: GYAE6OF02G2RZI.7.85.H08.1.454.CMB.1.raw
  modified_base (369)..(369): a, c, t, g, unknown or other
  misc_feature (369)..(369): n is a, c, g, or t
  modified_base (427)..(427): a, c, t, g, unknown or other
  misc_feature (427)..(427): n is a, c, g, or t
  modified_base (469)..(469): a, c, t, g, unknown or other
  misc_feature (469)..(469): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggagcttggttcaggcctggggggtccctgagactctcctgtgcagcctctggatttaccttcagtacttatggcatgaactgggtcccgccgaggctccgagggaagggctgcagtgggttcacacattaatactggaagtacgaccataacttanacagactctgtggaacggcgattccaccacctccagacgacgacgccaagactcactntctctgacaatgaacagcctagagtacgtcgaagacacggtntgtgttacttacgtgtcgacgagagacgtccgggaggggtactagacgtaccagtcgg

SEQ ID NO: 44590 - DNA, 523 bp, Homo sapiens
  misc_feature: GYAE6OF02FIHEI.7.85.H08.1.454.CMB.1.raw
  modified_base (307)..(307): a, c, t, g, unknown or other
  misc_feature (307)..(307): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggagtcgtgggggaggtcttggttcagccgtggggggtccctgagactctcctgtgcagcctctggtatttaccttcagtacttatggcatgaactgggtccncaggctccgagggaagggctgcagtggtttcacacattaatactggaagtaggaccataacttacacagactctgtgaacggccattccaccacctcagacgacacgccaaagacctnacgtctctcngacaagtnaacngccagagagtcgaagacgcgctgttntatacgtgagacgagacgagtcggtagggaacggtactagacgtactacg

SEQ ID NO: 44591 - DNA, 949 bp, Homo sapiens
  misc_feature: GYAE6OF02FJ54E.7.85.H08.1.454.CMB.1.raw
  modified_base (117)..(117): a, c, t, g, unknown or other
  misc_feature (117)..(117): n is a, c, g, or t
tcagcgtgtctctacacgaccggtgctcgatttagtatcactcagtagcgggggctctcagagaggtgccttagccctggattccaaggcatttccacttggtgatcagcactgacncagaggactcaccactggaggttgggtcgtcgttgcgttggttttccgttcgttgtctacttttagtaaggtgtcctaactgtggaggtgcacgcgtggtggagtcgtggggtagggcttggtctacgcccggtcggggtccgtcgaggacctcctccgtgtggacctacgcctcgtcggtacttaccctttaccgagttacttaacgttcggacctacttacggtaaccgttccggggttccgaccgtaacgggtccggttacccgaagggggtaacgggggtcctggtaccggtaacggtttcggggttttaccaaccaaccgttaaacgtttaaacgttaaccgttaggggtaaaacgggttaaacccgggtaacccgtaaacctttaaaaacccgtttaacccgaacgtaaaccggtaccgtttaaccgttcgggtttaagggaacccgggtaccccgggtaaaccgtttacccaaccccgtaaccccgttaacccgaaaccggtaaccggaacccggtaaacccggaccccgtaaaacccggtaaaccttacccggtaaccctaccggttttttaccgacccgttaacgtaacccgtaaaaccgttaacggtaaacccggtaaccgtaaccccgttaacggtaaaccggtaacgggttacccgggaaaccggtaaacccggtaccgggtaccgttacggttacggttaaacgtttaccggttaacggtccggtaaccggtaaccggtaacgggtaaccggttacccgggggtaaccgggggttaaccgttaacggtaaccggttaaccccggtagttaaccccgggg

SEQ ID NO: 44592 - DNA, 658 bp, Homo sapiens
  misc_feature: GYAE6OF02H7BZN.7.85.H08.1.454.CMB.1.raw
  modified_base (310)..(310): a, c, t, g, unknown or other
  misc_feature (310)..(310): n is a, c, g, or t
tcagcgtgtctctacacgaccggtgctcgatttagtatcactcagtcgcgggggctctcagagaggtgccttagccctggattccaaggcattttccacttggtgatcagcactgaacacagaggactcaccatggagttggggctgtgcttgggttttccttgttgctattttagaaggtgtccaatgtgaggtgcagctggtggagtcgtgggggaggtcttggttcagccgtggggggtccctggagactctcctgtgcacgcctctggtactttaccttcagtacttatggcatgaactgggtccnccgaggctccggaagggacggggctgcgagttgggttcactacattaaagtacgtggtaagtaggaccaataacttaacacagtacctcgtagtaggaacgggtaccgtaacttccaacccgaacctcccgaaaggaacgaaccgaacgaacccaaaacggaactccaaccgttgtccgttacctagacaaaaacgttcgaaacacgcccgttagacggtaacgttaccggaaagggaacccgtacggtcgttaggttacgttaacgtttaagtcgtacggtaccggaagacggttaaccgtccgggggaacggggtaaccgttaacgtacgaccgtaagttaccggg

SEQ ID NO: 44593 - DNA, 573 bp, Homo sapiens
  misc_feature: GYAE6OF02FNTMX.7.85.H08.1.454.CMB.1.raw
  modified_base (262)..(262): a, c, t, g, unknown or other
  misc_feature (262)..(262): n is a, c, g, or t
  modified_base (453)..(453): a, c, t, g, unknown or other
  misc_feature (453)..(453): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctntggtattaccttcagtacttatggcatgaactcgggtccgccgaggctcccgaggggaaggggctggcaggtgggtttcacgactattaatacgtgggaagtacggaccagtaacttacacagactcgtggtagaagggccgtaattcaccctacctcgagagacgaccgaccaagaactcactcgtctcngacaaagtcgaaaccagtaccctagaacggtacgtaccgaaggaccgacggctgtagtagttacgtggtgacggagaaggacgttaccggggagggtaccggtagtcggacctaggtacg

SEQ ID NO: 44594 - DNA, 730 bp, Homo sapiens
  misc_feature: GYAE6OF02H3WO2.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagagactcaccatggagttgggctgtgcttgggttttccttgttgtctattttagaaggtgtccaatgtgaggtgcagctgggtggagtcgtgggggaggcgtttggttcagtccggtcggggggtccctgacgacctctccgtgtcgcgacgtcctcgtggtacttttaccttacaacgttactttagtggctagttacgaaccgtcggtcccgccgacggccgttaccgaggggaacgggtctgcgtagggtttcggtttacacctaataatttaacgtaacgtacgggtaaagtacggaacctaaacttaaaccttaacaccgtaagaccttcgttaggtacgggaaccggggtacctaagtttaccccaaccctacccgtaccgaaacggacgaaccggaaccgacccgaaagtaccctacgtaccgtttcgtcctaaccgtagaacctaaaacgtcgtaaaccacgccgttaaaggaacggtacggttccggaaacggacggtaccgtagttcgttacggtttattaacggtggttaacggacggtaaggtacggtacggttaccggggagggtaaccgttagtaaccggtaccgtaggttaccgg

SEQ ID NO: 44595 - DNA, 711 bp, Homo sapiens
  misc_feature: GYAE6OF02JUQID.7.85.H08.1.454.CMB.1.raw
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (428)..(428): a, c, t, g, unknown or other
  misc_feature (428)..(428): n is a, c, g, or t
tcagcgtgtctctacacgaccggtgctcgatttagtatcactcagtcgcggggacgtctcagagaggtgccttagccctggattccaaggcatttccacttggtgatcagcactgaacacagaggactccaccatggagttgggctgtgctgggtttccttgttgtcttagttttagaaggtgtccaatgtgaggtgcagcgtgggtggagtcgtggggacgcgttcggttcgaggccgtggggggtccctggacgtctctcctgtgtcaggtcctcgtggtaactttacctcgagttactagtcggctntacgtaacgtcgggtccnccgtaggcctaccggaggggaacgggtccaggcgtacggttcgggttccaaccgtagtaacttaacttacgaagtaacgtaacggaacctacgttaaacncgtaacgatactacgtgtacggaagtaccgtatacctaccgtacctaacgaacgacggaccgtaaccggaccaaacggttaactcgtaaaccgtttgtaccctacggtacgtaacctaaagttaacgtaccggaccgtcccggtaaaggaaccggtcgttaaccggaaacggtcccgtaaacgggttcttcggttacgttacttacggccggttggacgaaccggttaacggacggtacccggggtaagggtacccgtaagtaccgtaacccgtgttacccgg

SEQ ID NO: 44596 - DNA, 622 bp, Homo sapiens
  misc_feature: GYAE6OF02FWHF8.7.85.H08.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (480)..(480): a, c, t, g, unknown or other
  misc_feature (480)..(480): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctntggtatttaccttnagtacttatggcatgaactgggtccnccaggctcgagggagggctgcagttgggttcacactattaatacgtaggaagtacggaacctaattaacttacgaactacgtactcgtagtacggaagggtccgatttaccaccctacctcccaaggacgaccgacgaccaaacgtacctacacgtgttacctctagaacctaaancgtaaaccagccgtagaacggtaggtccgaaaggaccgtacgggtcttagttacggttaacttaccggtggtacgacggggaaggtacggtaacggttacggggggaggggtaacgttaggtaccgtaacccgtgttaccgg

SEQ ID NO: 44597 - DNA, 672 bp, Homo sapiens
  misc_feature: GYAE6OF02HETFF.7.85.H08.1.454.CMB.1.raw
  modified_base (514)..(514): a, c, t, g, unknown or other
  misc_feature (514)..(514): n is a, c, g, or t
  modified_base (553)..(553): a, c, t, g, unknown or other
  misc_feature (553)..(553): n is a, c, g, or t
  modified_base (589)..(589): a, c, t, g, unknown or other
  misc_feature (589)..(589): n is a, c, g, or t
  modified_base (662)..(662): a, c, t, g, unknown or other
  misc_feature (662)..(662): n is a, c, g, or t
tcagcgtgtctctacacgaccggtgctcgatttagtatcactcagtcgcggggcgtcgtcagagaggtgccttagacctggattccaaggcatttccacttggtgatcagcactgaacacagaaggactcaccatggagttggggctggtgctggggttttccttgttgtcttattttagaaggtgtccaatgtgaggtgcagcgtggtggagtcgtggggggaggtcgttgggttcgaggccgttgggggggtcccctggtacggaccgtcttccgtggttcgacgacggccttcgtggtacttttaccttcgagttacttacgtggccattcgaacgttcgggtcccgaccgagggtcctaccggaggggaacggggtctaggaccgagggttcggggtttacaacgtaccgtaaagttaaacgtactaggggtaaacgtaggtaacccgtaattaaactaccgaacaggtacctagtcgtagtaacggggactactcgaacctacctcganaacggtacgacacccgaagaacctcgaactgtactcganacaaatacgtacaacgctagagacgtcgaaggaacnccggtatggtatacgtttcgtgacgtcgaaggtaccgaggttccgggaaggggtaccgtaagtaccgtaccgngtttaaccgg

SEQ ID NO: 44598 - DNA, 580 bp, Homo sapiens
  misc_feature: GYAE6OF02ICKKP.7.85.H08.1.454.CMB.1.raw
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (459)..(459): a, c, t, g, unknown or other
  misc_feature (459)..(459): n is a, c, g, or t
  modified_base (516)..(516): a, c, t, g, unknown or other
  misc_feature (516)..(516): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaaggtgtccaatgtgaggtgcagctggtggagtcgtgggggagtcgttggttcagccgtggggggtccctgagactctcctgtgcacgcctcgtggtacttttaccttcagttactttatggctagtgaacgtcgggtccgccaggcctcgagggagggctgcagtggttcacactattaatcgtaggaagtaggacaattaactacananactntagagacggctatcacccactcagacgacgacgaccaagactcactgtctctagacaaaagtcgaaacncgtacctaggaagacggtaaccggaggaaccgacggtactgttagttaactttacgngtacggacgaagtacgacggtcggggtaacgggtaccgttagtaccggaacccgtagttaccgg

SEQ ID NO: 44599 - DNA, 786 bp, Homo sapiens
  misc_feature: GYAE6OF02GLXJB.7.85.H08.1.454.CMB.1.raw
tcagcgtgtctctacacgaccggtgctcgatttagtatcactcagtcgcgggggcgtctcagagaggtgccttagccctggattccaaggcatttccacttggtgatcagcactgaacacagaggactcaccatggagttgggctgtgctgggttttccttgttgcttatttagaaggtgtccaatgtgaggtgcagcgtggtggagtcgtgggggaggtcgtttggttcgaggtcccggttgggggggtcccctgggagtaccgtccgttcctggttcgccgtacggtcccttcgtcggtaacttttaccctttcgaagtttacctttaagtcgggacctagtcggtaaccgttcgggggttacccgacccgtaacgggcccgttacccggaaaggggggaacgggggtccttgggaccgtaacgggtttcggggtttaccacgtaacgtaatttaaacgtacgtaggggaaacgttacggaacctaagtaaaaccgttacaaacgacgtacttcgtaggtacggaaacggtcccgtaattacccaaccctaccgtaccgaaggaacgaaccgaccgacccaaagaccttccgacgttactcgtacctagaaactaaactagaaaccacgtaccgtagaaaggtaccggttaaccggaacggaaccgtaaccgggtctttacgggtacttaaaccgtttacggttcggtaggaacccggaaggtaacccggtaacggtacccgggggaacggggtaacttaggaccgtaaccggtagttaccggg

SEQ ID NO: 44600 - DNA, 533 bp, Homo sapiens
  misc_feature: GYAE6OF02FR5BL.7.85.H08.1.454.CMB.1.raw
  modified_base (454)..(454): a, c, t, g, unknown or other
  misc_feature (454)..(454): n is a, c, g, or t
  modified_base (495)..(495): a, c, t, g, unknown or other
  misc_feature (495)..(495): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgagactctcctgtgcagcctctggtatttaccttcagtacttatggcatgaactgggtccgcaggctccgagggagggctgcagtggttcacacattaatacgtggaagtaggaccaataacttacacagactctgtagaacgggcctattccacctaccctcagtacgaccgacgaccaaagacctcactgtcctctgacaaatcgaacngacctagagacgtgaacggacgacgcttgtacgtatcgtgngacgagagtagtccgggagggacttgacggacctgtcg

SEQ ID NO: 44601 - DNA, 683 bp, Homo sapiens
  misc_feature: GYAE6OF02GA2VB.7.85.H08.1.454.CMB.1.raw
  modified_base (264)..(264): a, c, t, g, unknown or other
  misc_feature (264)..(264): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcttggttcagccgtggggggtccctgagactctctgtgcagcctntggtattttacctcagttacttagtggctatgaacgtgggtcccgccgaggcctccggaggggacgggctggctaggtgggtttcacgactattaatacgtaggaagtacggaacctaagtaacttacacagacctgttaggtacggaacgggccgtacttacccgacccgtaaccctcccgaaaggaaccggaaccggtaaccgaacccgaaaacggtaacccttaccgaaccgtttcgttacccttacgtacgaacctaaaagttacgaaaccgacgtaccgttaggaaacggtacggtaaccggaacgggaacctaaccgggtcttagggttacttaagtttacgtggtacggacggtaacgaacgggtacggtaccggggaacggggtacgttaagaccggaaccgtaggttacg

SEQ ID NO: 44602 - DNA, 682 bp, Homo sapiens
  misc_feature: GYAE6OF02GF7GV.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaggtgtccaatgtgaggtgcagctggtggagtcgtgggggagcttggttcagccgtggggggtccctgagactctcctgtgcagcctcgtggtattttacccttcagttaccttatcgggctagtgaacgtgggtcccgccaggcctccggaaggggagggctggcgaggttcgggtttcacactattaatacgtaggaagtacggacctagtaacttacaacgagtactcgtggtaggaacgggcctattacccaccgtacctccgaaggaacgaccgaaccgacccgaaacggtacctaccgtaacttcggtaccttacgtacgtaacctaaaagttcgaaaaccgtacggtaccccgttaaggaaggtaacggttaccgggaacgggtaacccgaacgggtccgttaggttacgttaagtttacggtggtacggacgggtaaggtaacggtacggtacccgggggtaacggggtaaccgttacggacgtaacctggttaacccgg

SEQ ID NO: 44603 - DNA, 720 bp, Homo sapiens
  misc_feature: GYAE6OF02HWJ0D.7.85.H08.1.454.CMB.1.raw
  modified_base (210)..(210): a, c, t, g, unknown or other
  misc_feature (210)..(210): n is a, c, g, or t
  modified_base (338)..(338): a, c, t, g, unknown or other
  misc_feature (338)..(338): n is a, c, g, or t
tcagcgtgtctctacacgaccggtgctcgatttagtatcactcagtcgcgggggcgtctcagagaggtgccttagccctggattccaaggcatttccacttggtgatcagcactgaacacagaggactcaccatggagttgggctgtgctgggttttccttgttgctattttagaaggtgtccaatgtgaggtgcagctggtggagtcgnggggaggcgttggttcagccgtgggggtcctgagactctcctgtgcacgctcgtggatttaccttcgagtacgttatcggactaatgaaccgttggtcccgacgaggctccgaaggaacggggctcgngtacggttgggtttaccacgtaactagttaaactcgtagggaaaggttcggaacctaataaaccttacgaaccaaggtaaccttcgtaggttaagggaaccgggtaccgtaagtttcccgaaccgtaccccgtaacccctaggacgaaccgtaccgaccgaaacgtaaccgcctaaacgtcgtctaccgtgtaacgtaaaacgtcgaaaccgtagaacccgttggaaacgtacgtacggaaccgggtaacgaacccgggtacttacgggttacgttaaccgtttaacgtcggtttacggaccggtaacggttaacggaacggtttaacccgggggacgggtaaaccgggtaacttaccggggtaaccctaagggttacccgg

SEQ ID NO: 44604 - DNA, 740 bp, Homo sapiens
  misc_feature: GYAE6OF02JST7W.7.85.H08.1.454.CMB.1.raw
  modified_base (348)..(348): a, c, t, g, unknown or other
  misc_feature (348)..(348): n is a, c, g, or t
  modified_base (416)..(416): a, c, t, g, unknown or other
  misc_feature (416)..(416): n is a, c, g, or t
tcagcgtgtctctacacgaccggtgctcgatttagtatcactcagtcgcggggcgtctcagagaggtgccttagccctggattccaaggcatttccacttggtgatcagcactgaacacagaggactcaccatggagttgggctgtgcgttgggttttccttggttgtcttattttagtaaggttgtcctaagtgtggaggtgcagctgggtggagtcgtggggaggtcgttggttcgagccgtggggggtccctggacggtcctctcctggtcgcaggtccctcgttgggtacttttaccttactacgttacttacgttggactattaggaaccgttggggtacccnccgtaggtccgtacccggaagggggtaagggcctgggctagggttcggtttcaacgtactaagttaancgttaaggagtacgaactaactaaacttacacaagcttacgtaggtagaacgggtccgtaacttaccacccctccgtaacccgagaaccggtaaccggacgaaccctaaaacgaaaccttaccgtaactcgttaccgtcctacgtaaactaaaacgttcgaaaccgaactacccgttagggaacggtaaccggtacgaacgggaaaccctcgggtaacttaccggttacgtttaattaacccgggtagtcggtacgtaaacgggtaggaacgggttaccgggaaacgggggtaacttacggtaacgtacccggaacgttaacgg

SEQ ID NO: 44605 - DNA, 719 bp, Homo sapiens
  misc_feature: GYAE6OF02HTDT1.7.85.H08.1.454.CMB.1.raw
tcagcgtgtctctacacgaccggtgctcgatttagtatcactcagtcgcgggggctctcagagaggtgcctttagacctggattccaaaggcatttcccacttggtgatcagcactgaacacagaggactcaccatggagttggggctgtgcttgggttttccttgttgcttattttagaaggtgtccaatgtggaggtgcagctggtggagtcgtgggggaggcttggttcagccgtggggggtccctgagactctcctgtgcacgcctctaggtattttaccttctagttacttagtggctagtgtaacgtcgggtcccgccgaggcctccggaagggaacgggggctggcgtaggttcgggtttaccgaccactaagtttaactacgtaggtaaggttacggacctaattaaacctacacgtacgtacgttccgtcgtaagggaacggggtaccgtaacgtttaccacccctaaccccgttacccgaacggtaacgaaaccggaacccgacccgtaaacgtaaaccctaccgtaaccgttcgtccctccgtagtaaccgaaaagtccgtaaaccgacgcgtagaacggtacgtaccgggaaggaccggtaccggtcgttacgttagttccgtttaacgttgggtaccggtacggaaggtacggaacgggttaccgggggaacggggtaccggttaagtaccggtactagttacggg

SEQ ID NO: 44606 - DNA, 816 bp, Homo sapiens
  misc_feature: GYAE6OF02GLD21.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggagtctgtgtcggttcgggttttccttggttgtactttaagttttaaggaagggttcgtacctaagttggtggtaggtgacgagtcggtgggtaggtacggttcgggtggggggagttcgttcggtcacggtccgggtcgggggtcctggacgtacctccttcgtgtcgcgtacgtccttgtaggttaccttttacctacgtacgttacttagtggtactagtacgtaaccggtcgggtcccaccggacggtccgtaccgggaagggggacgggtcgtcggacggttacgggtttcggttacacgtacttaagttaacgtacgtaagggaagtaacggaactaacttaaccgttaacaacgtaagtcctacggtcggtaacgggaccgggtccgtaactacccgaaccctacccgtacgaacggtaacgaacccgtaaccgaaccgtaaacgtaaccgttcctacgtttccgtacctacgtacggaaacctaaagtacggaacctacggggtaccctagggaaccggtacggttaaccgggaacggtaacccggtacgggttacgtttggttaacggttttaaccgttacggttagggtaccggacgggttaacggaaccgggttaccgggtacccgggggtaagggtaaccggttacgtaccggaacgtttcggg

SEQ ID NO: 44607 - DNA, 961 bp, Homo sapiens
  misc_feature: GYAE6OF02JVV1H.7.85.H08.1.454.CMB.1.raw
  modified_base (918)..(918): a, c, t, g, unknown or other
  misc_feature (918)..(918): n is a, c, g, or t
tcagcgtgtctctacacgaccggtgctcgatttagtatcactcagtcgcgggggcgtctcagagaggtgccttagccctggattccaaggcatttccacttggtgatcagcactgaacacagaggactcaccatggagttggggctgtgcgttggttttccttgttgtcttatttagaggtgtcaatgtgaggtgcagcgtggtggagtcggtgggggaggtcgttggttacgaggtccggttcgggggggttccctggacgtacgtcgtccgtggtacgctacgtccgtcgtcggtacttttaccttcgtagttaccttagtcggactacgttacggtaaccgttcggggtcccgtaccggacggtacccggttacccggaagggggggtaacggggtcgttacggacggtacgggttttaggggttttacccaaacccgtaacgttaaacgtttaaacgtttaccggttaaagggggaaacggtttaacggaaaccgtttaaacctttaaaaccgtttaaaccgtaaccgtaaaacgtaccgttttaccggtaggggttaaccgggtaaacgggtccccggttaaactttacccccgaaacccttaaacccccggttacccggaaagggtaacccggggaaacccgggtaaaccccggaaaccgtaaaaccgggtaaaccttaccccgggtaaaccgttttccgggtttacccgttaacccgtagttaaacccccggtaaaacggtttaaagaaaccccggttaaccgggttccgttaaccggggtaaaggggaaccggttacccggggaaacgggtaaaccccggttcgggtaccggttagtttacccgggttaattttacccggtagggtcgggttaaccgaaagggtaacccgggtcggttaacccggggggnggggtaaaccgtttacgaccggttaacgtacgttaacccgggg

SEQ ID NO: 44608 - DNA, 714 bp, Homo sapiens
  misc_feature: GYAE6OF02HMRSC.7.85.H08.1.454.CMB.1.raw
  modified_base (327)..(327): a, c, t, g, unknown or other
  misc_feature (327)..(327): n is a, c, g, or t
tcagcgtgtctctacacgaccggtgctcgatttagtatcactcagtcgcgggggcctctcagagaggtgccttagccctggattccaaggcatttccacttggtgatcagcactgaacacagaggactcaccatggagttggggctgtgctgggttttcctgttgcttattttagaaggtgtccaatgtgaggtgcagctggtggagtcgtggggagcttggttcagtccgtgggggtccctgagactctccgtgtcgcacgcctgtggtacttttaccttcgtaacgttactttagtcggctagttacggaacgttcggggtcccnccgtaggccctaccggaggggaacgggctggacgtaggttcgggtttacaacgtactaatttaacgtacgtaggaacgtacggacctaattaaacttacaacgacgctcgtgtaggaacgggtctattacccacccgtaacctacccgaaggaaccgaccgaaccgaccgaaacgtacctcgaaccgttgtaccttaccgagtaacctaaacgttcgaaacccgtgtacccgtaggaacggtaccggtaccggaaacggggtaaccctaccgggtacttacggttacgttaacgtttaccggtggtaccggaacggtaaacgggacggtaaccggttccgggggtaacggtaccgttaacgtaaccggaacccgtagttaacccggg

SEQ ID NO: 44609 - DNA, 746 bp, Homo sapiens
  misc_feature: GYAE6OF02J24KE.7.85.H08.1.454.CMB.1.raw
  modified_base (717)..(717): a, c, t, g, unknown or other
  misc_feature (717)..(717): n is a, c, g, or t
tcagcgtgtctctacacgaccggtgctcgatttagtatcactcagtcggcgggggctctcagagaggtgccttagccctggattccaaggcatttccacttggtgatcagcactgaacacagagactcaccatggagttgggctgtgcttggtttcctgtgctagtttagaaggtgtccaatgtgaggtgcagcgtggtggagtcgtggggaggtcttggtacgacggtccgtcgggggtccctaggtacgtcctccgtccgtagtcgactacgtccttcgtacggttactttaccgttaccgaagttacgtaagtcggactacgttacggtaaccggtccgggtaccgaccgtacggcgtaccggaggggtacggtcgtacggacggttacggttacggttaccaacgtacgttaacgttaacgtacggtaacggtaacggtacggtaacctaacgttaaccgtacacgtacgtacgtacgtaggtacggtaacggtactaacgtacccgacctacgtaacgaacggtaccgaacggaccttaacaaacgtccttcgaaccgtcgttactactacggaaaccctaagtcgtaaacaccggttacgtaaagggacgtacggtaaccgtaacgaacggtcgttagttagtttactacgttacgggtcgtacgaacccggaagttcccgggaaccgggttaacggggaacggttaaccngtaacccggtacggttaacgttacccggg

SEQ ID NO: 44610 - DNA, 793 bp, Homo sapiens
  misc_feature: GYAE6OF02F1U0I.7.85.H08.1.454.CMB.1.raw
  modified_base (584)..(584): a, c, t, g, unknown or other
  misc_feature (584)..(584): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctatttagaggtgtccaatgtgaggtgcagctggtggagtcgtgggggaggcttggttcagccgtgggggtccctgacgactctcctgtgcagcctctggtacttaccttcagttacttagtcggctagtcgaacgtcggggtcccgaccgacggtccgtccggaaggggaacggggtctcggacgtagggttcgggtttaccaaccgtaactaactttaaacgtaccgtagggtaaaggtaaccggaacctaacgttaaaaccgttaacaacgtaacgtaccttacggtaggtaagggaacgggtccgtaacgttacccgaacccgtaaccctacccggtaaacgaacgtaacccggaacccgacccgaaaacggtacccttaaccaccgtttacgttcctaccgtcgaaacctaaanccggaaactaccggtacccgttaaggaacggttacggttaccggaaacggtacccggaacgggttcccgttagggtttaccgtttaaacgttaccggtttagggttaaccggtaacggggtaaggaaccggggtttaaccgggtaccgggggggtaacggggtaaccggttttaaggaaccgggtaacccgttaggtttaaacccgggg

SEQ ID NO: 44611 - DNA, 715 bp, Homo sapiens
  misc_feature: GYAE6OF02F3GF1.7.85.H08.1.454.CMB.1.raw
  modified_base (397)..(397): a, c, t, g, unknown or other
  misc_feature (397)..(397): n is a, c, g, or t
  modified_base (492)..(492): a, c, t, g, unknown or other
  misc_feature (492)..(492): n is a, c, g, or t
tcagcgtgtctctacacgaccggtgctcgatttagtatcactcagtcggcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtcgtgggggagtcttggttcagccgtgggggtccctggagactctcctgtgcacgcctcgtggtattttaccttcagttacttagtggctatgacgtgggtcccgcgaggctccggaggggaagggtctggcgtaggttcgggttcactactaattaatacgtaggaagtacgactaataactacaacanactcgtaggtacgggaacggccgtacttaccaacctaccctacgagtaacgaccgaaccgacctaaacgccgtacctacgttcgttcctacgtanaacctaaagttacggaaacctaccgggtaccttaaggggaacggtaacggttacccgggaaaccgggtaacccggtacggggtacctttagggtttaccgtttaaggtttacccggtttagggaccggtaacgggtaacggggtaaccgttacgggggttaaccggggggtaacgggggttaacccgttaggttaacccggtaaccgtacgggtttacccggg

SEQ ID NO: 44612 - DNA, 693 bp, Homo sapiens
  misc_feature: GYAE6OF02IDYBA.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgcttggttttccttgttgcttattttagaggtgtccaatgtgaggtgcagcgtggtggagtcgtgggggaggcttggttcaggccgtggggggtccctggagtactctcctgtgcagtcctcgtggtacttttacctctagttacttatggctatgaactgggtccgccgaggctccgagggagggcgtcgcgaggttcgggtttacacgtactaattaacgtacgtgggaaacgttagggaacctaattaaacgttaaccacgaacgtaccttacgtgtacgggaacggggccctatttaccgaccctaccctaccgacgaacgtaccgaaccgaccgaaacgacctaccgaacgtttcgtactccgttagaacctaaagtcgaaacctacggaccgtaagacggtacggttacgaccgggaaacgtaccggtcgttagttacggtttaactttacggacggttaaggacccggtaaagacgggttaccggtaccggggggtaacgggaaccggtttaggtaaccggtaccgtagttaaccgggg

SEQ ID NO: 44613 - DNA, 849 bp, Homo sapiens
  misc_feature: GYAE6OF02G4S7V.7.85.H08.1.454.CMB.1.raw
  modified_base (281)..(281): a, c, t, g, unknown or other
  misc_feature (281)..(281): n is a, c, g, or t
tcagcgtgtctctacacgaccggtgctcgatttagtatcactcagtcgcggggcgtctcagagaggtgccttagccctggattccaaggcatttccacttggtgatcagcactgaacacagaggactcaccatggagttgggctgtgctggtttccttgttgctatttagagtgtccaatgtgaggtgcagctggtggagtcgtggggaggcgtttggttcaggccgtggggggtcctgagcctcgtccgtgtcgctagcctcgtagtacttttaccgttnacggttactagtcggctagtacgtaacgtcgggttccgaccgtacggccttaccggaacggggacgggtcctagggccgtaagggtttccggggtttaccaaccgtacgttaaacgtttaaacttaccggtaaggggtaacggttaaaccggggtaaacctaacgtttaaaaaccgtttacgaacccgtaaacgggtacccttaccgggttgttaaacgggaacggggtcccggtaacttttaacccggaacccttaaaccccgtcccgaagggaaccgaaaccggtacccggtaacccgaaaaccggttaaaacctccgtaaaccggtttctacccgttacgttaccgggaacaaaacggttacgtaaaccgacccggttaccgtaagggtaacgtacgggttaaccgggaacggtaaccgtaaccggggtacgtaccgttttaggttaaaccggtttacccggttaggttaccgggacccgtaaaggggtaacggttaaccccggtaccggggggggttaaacgggacgttttaacccggaacgtaacccgtaggttaacccgggg

SEQ ID NO: 44614 - DNA, 552 bp, Homo sapiens
  misc_feature: GYAE6OF02IBC9C.7.85.H08.1.454.CMB.1.raw
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgctattttagaaggtgtccaatgtgaggtgcagctggtggagtcgtgggggagtcttggttcagtccgtggggggtccctggacgactctcctgtgcagcctctggacttttacctcagtacttatggcatgaacgtgggtccgccaggctcgaggggaagggctgcgaggttcgggtttcactacatttaaactacgtggaagtacggacctaattaaacctacacagactcgtgtagaacgggcctattccgaccacctccgagacgacgacaccgaanaactcacgtgtctctgacaaatgaacngctgagtcgacgagcagctgtagtattgngtacggcgtaagacgacggtccgggaagggacgttagtacgaccgtagtcgg

SEQ ID NO: 44615 - DNA, 807 bp, Homo sapiens
  misc_feature: GYAE6OF02J1FSS.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcttggtttccttgttgctatttagaggtgtccatgtgaggtgcagcgtggtggagtcggtggggaggtcgttggttacgacggtccggttcggggggttccctggacgtaccttccgtccgttcggtgcctacgtcccttcgtaggttacttttaccccttacgtaagtttaaccgtttagtcgggtactacgttacggtaacggtcgggttcccaccgtaggtccgttaccggaagggggaacgggtcgtcggaccgtagggttcgggtttaccaaccgaacgtttaagttaacgtaccgggttaacgggtaaagtaaccggtaacctaacgtttaaacctaaccgacgtaactaacgtttccggtaggtaacgggaacggtacccgttaacttacccacccggttaacccctccggaaaggaccggtaaaccggaccgttaacccggaaaattaccggtacctaccgtttcggtacctttaaccggagaacccgtttaaagacggtaaaccgtccgccgttaaagacccggaccgggttccggaaacgtaacggccgttacgttagttacttacggtaggtacgggaggaacgtaaggtaaccggtttaccggggagtttaccaccgttagggtttacggaaccgtaaggttaaccgg

SEQ ID NO: 44616 - DNA, 683 bp, Homo sapiens
  misc_feature: GYAE6OF02JW7UH.7.85.H08.1.454.CMB.1.raw
  modified_base (589)..(589): a, c, t, g, unknown or other
  misc_feature (589)..(589): n is a, c, g, or t
  modified_base (614)..(614): a, c, t, g, unknown or other
  misc_feature (614)..(614): n is a, c, g, or t
  modified_base (621)..(621): a, c, t, g, unknown or other
  misc_feature (621)..(621): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttcctgttgctatttagaaggtgtccaatgtgaggtgcagctggtggagtcgtgggggaggcttgggttcaggccgtgggggggtcccagtagacctctcctgtcgcagcctcgtggtactttaccttcgtagtacttagtggctatgtaacgtgggtccacgaggccgtaccggagggggaaaggggcctaggccgtagggttcgggtttaccgactaacgtaacttaaagttacgtaggaacgggttaacggaacctaagttaaaaccttacgaaacgtagtaaccctagtcggttaagggaacgggggtccaactttaccgaccccgaacctcccgaaaggtaacggaccgaccgaaaccgaacgtaaccgttaccaaccggtttcgtaccttaccgttcgaacaaagttaccggaaaactcgtaacccgngtaacggaagtccgaaaggtaccgnggttacnggttacttgtacgtgtgacgtaggacctggaccgggtaggaccttagcggaacctagtacgg

SEQ ID NO: 44617 - DNA, 596 bp, Homo sapiens
  misc_feature: GYAE6OF02GXQXQ.7.85.H08.1.454.CMB.1.raw
  modified_base (305)..(305): a, c, t, g, unknown or other
  misc_feature (305)..(305): n is a, c, g, or t
  modified_base (474)..(474): a, c, t, g, unknown or other
  misc_feature (474)..(474): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggagcttggttcagccgtggggggtccctgagactctcctgtgcagcctctggtactttacctcagtacttagtggcatgaacgtcggtccncgaggctccgaggggaagggctgcgtaggttggttcaactactaattaatacgtaggaagtacggaacctaataaaccttacaacgagtactcgtagtaggaacgggcctattacccaacctaccctaccgaagaaccgacgaccaccaaagaacctcaactcgtctcngaacaagtcgaacacgcctagagacggtacgaaggaccacggtctggtagtactttacgtaggtcgacggtaagtaaggtacgtaccggggaggggtaaccttagacggtaccagttaccgg

SEQ ID NO: 44618 - DNA, 736 bp, Homo sapiens
  misc_feature: GYAE6OF02JS9KI.7.85.H08.1.454.CMB.1.raw
  modified_base (221)..(221): a, c, t, g, unknown or other
  misc_feature (221)..(221): n is a, c, g, or t
  modified_base (535)..(535): a, c, t, g, unknown or other
  misc_feature (535)..(535): n is a, c, g, or t
  modified_base (548)..(548): a, c, t, g, unknown or other
  misc_feature (548)..(548): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcacatggagttgggctgtgctgggttttcctgttgctattttagaacgtgtcaatgtgaggtgcagctggtggagtcgtggggtagcttggttnaggccgtggggggtcctggagactcgttcgtggtcgacgacgtccgtcgtcggtacttttaccgtcgtacgttaccttacgttacgcgacttaacggtacggttaaccggtccggtcccggtaacgcggttacccgtacggggaacggggtacggtgtacccggtaggttccgggtttcggaacctaactacgtaacgttaaccgtaacgggtaagtaacggtaacgtaaccttaataacgtacgaacttacgacgttaggtacgtacgggaaccggtacgttacgtaccacctaccgtaactcgaacggaacncgaaacccgtaanaaccttaccgtacttcgagtaccgtataacgaactacgaacgtacgtacgagaaccggtaggaccggaaacgcggtaccgtaggtttacgtacgtttacggtacgttaacgggtcggtaaggttaccgaagggtttaccgggaaaccgggggtcggtaacgggtttaccggaccttaagggtacccgg

SEQ ID NO: 44619 - DNA, 640 bp, Homo sapiens
  misc_feature: GYAE6OF02JHA6K.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaaggtgtccaatgtgaggtgcagctggtggagtcgtgggggaggtcgttggttcaggccgtcggggggtccctgagcctctcctgtcgcacgcctcgtggtactttacctctagtacttatgggcagtgaacgtcgggtcccgccgacggcctaccgaaggggaacggggctggcgtagggttcgggtttacaccaactaattaaatacgtagggtaaagtacggaactaattaaacttacacgtaacgtactcgtggtacggaacgggcctacgttacccaccctacctaccgaagacgaccgacgaccgaaagtacctcacgtcgtacctgtacactaaagtcgaaacacgtaccgagaaggtacgaccgtaacggaccgacgtgtagttcggttaacttacgtgggtacacgggaagtagtacggacggggacgggtaccgtagtacgaccgtagttaccgg

SEQ ID NO: 44620 - DNA, 532 bp, Homo sapiens
  misc_feature: GYAE6OF02G99ZL.7.85.H08.1.454.CMB.1.raw
  modified_base (414)..(414): a, c, t, g, unknown or other
  misc_feature (414)..(414): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccgagggagggctgcagtgggtttcacgacattaatactggaaagtaggaccataacttacacagactctagtgaacgggccattccacctacctcagagacgacnccaagactcaactgtctctgacaaatcgaaacagaccctgacgagtacgaggacacgggntggtgtattacgngtcgcgagtacggagtacccgggagggactagtacgaccatacgg

SEQ ID NO: 44621 - DNA, 749 bp, Homo sapiens
  misc_feature: GYAE6OF02HCK8H.7.85.H08.1.454.CMB.1.raw
  modified_base (321)..(321): a, c, t, g, unknown or other
  misc_feature (321)..(321): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctgggtggagtcgtgggggaggcgttggttcagccgtggggggtccctgacgactctcctgtcgcacgccttctggtacttttacccttacagttacttatcggactagtgaacgtgggtcccnccgacggccgtccgaaggggaacggggctcggctaggttcgggtttcaacgactattaaacgtacgtaggaagttacggaacctaagttaaaccttacaacgacgtactacgtgtacggaacgggtcctaacgttcccaacccgtaccgttacccgaaggacggaaccgaccgaccaaacgtacctactaaccgttcgttaccgtactacgaccctaaaaggttaccgaaacgtaccggtaccccgttaaggaacggtaaccggtaccggggtaacgggaaaccccgtacgggttacccttagggttaccggttttaagtttacccgttggggtaaccggtaaccgggtaacggtaacgggtaaccggttacccggggggaacggggttaccgttaacgtacccgggtaacctaacgggtttacccgg

SEQ ID NO: 44622 - DNA, 672 bp, Homo sapiens
  misc_feature: GYAE6OF02J16X2.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttgggttcagtccgtggggggtccctggagactctcctgtgcagcctctggtatttaccttctagttacttatggctatgaactgggtccgccaggctccgaggggacgggctgcaggtcgggtttcacgactataatacgtagggtaagtaggacctaagttaaccttaacaacgtagtaccttcgtagtaggaagggtcccgtaagtttccaaccctaccgttacccaaggtaacgaaccgaacggacccgaaaggtaaacctaccgtaaccttcggttaccttccgttacgaactaaaacgttacgaaaccgtaacggtccctagggtaacggacgttaaccgggaacgggtaaccgtaacgggtccgttagggtacttagtttaaccgtggttacggacgaggtacggaggtacccggggaggggtaacgtagtacgaccgtagtacgg

SEQ ID NO: 44623 - DNA, 722 bp, Homo sapiens
  misc_feature: GYAE6OF02HLTS6.7.85.H08.1.454.CMB.1.raw
  modified_base (648)..(648): a, c, t, g, unknown or other
  misc_feature (648)..(648): n is a, c, g, or t
  modified_base (670)..(670): a, c, t, g, unknown or other
  misc_feature (670)..(670): n is a, c, g, or t
  modified_base (714)..(714): a, c, t, g, unknown or other
  misc_feature (714)..(714): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtgcagctggtggagtcgtgggggaggcttggttcagtccggtggggggtcccctggacgacttccgtccgtgtcgcacgcctcgtggtacttttaccttctacgttacttagtcggactagtacgtaaccgttcggggtacccgtccgacggccgtaccggaagggggaacggggtccgtcggcgtaacgggttcgggtttaccaactaaccgtaatttaaacgtaccggtaggggtaaacgtaacggaaccctaaattaaaccgttaaccaacgtacgtaaccttacggttgggtaacgggtaacggggtacccgttaacttccccaacccgtaaccccgtaccgaaagggacccgaacccggaccgaacccgaaaacggtaccctacgtacccgtttgtccctaagtcgaactaaatcgaaactaccggcctaggacgaacgtcgaacggacncgggtctggtacttagttacgnggtacgacggtagtacgacggtcggggaaggtactagcgtacgngttaccgg

SEQ ID NO: 44624 - DNA, 780 bp, Homo sapiens
  misc_feature: GYAE6OF02J0UKS.7.85.H08.1.454.CMB.1.raw
  modified_base (602)..(602): a, c, t, g, unknown or other
  misc_feature (602)..(602): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcgttgggttttccttgttgcttattttagaaggtgtcaatgtgaggtgcagcgtgggtggtagtcggtgggggaggtcgttggttcgacggtccggttcggggggtccctaggacggtaccttccgtccgttggtacgccgtacgtccctttacgtacggttaactttttaccccgtttacgtaacgtttacgtttaagtcggtactagttacggtaaccggtcggggttcccgaccgtacggtccgtaccggggaacggggtaacggggtcctacgggtacgttacgggttcgggtttaaccacgtaacttaacgttaaacgtacggttagggaaacgttacggaaacctaagttaaaaccgtacaacgtaacgtacgttggtacggtacgggaacggtaccgtactacccaacccgtacctacgagaacgtaaccgaacgtacgaactaaccncgtactcggtactagtacgaactagaacgtacgacggtactaggtaacgtacgggtaccgaacgggtaacccgtcgggttactggtttaacgttacgttagtccgggttagacggttaaggaaccggtacggggtaccgggtaagggtaaccctggtaaccgaccgttaggtaaccgg

SEQ ID NO: 44625 - DNA, 660 bp, Homo sapiens
  misc_feature: GYAE6OF02J2DRU.7.85.H08.1.454.CMB.1.raw
  modified_base (408)..(408): a, c, t, g, unknown or other
  misc_feature (408)..(408): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgcttgggtttccttgttgctatttagaaggtgtccaatgtgaggtgcagctggtggagtcgtgggggagtcttggttcagccgtggggggtccctgagactctccgtgtcgcacgtcctcgtggtactttacctcgtagttacttagtcggctatgaacgtcgggtccgccgaggcctaccgaggggtacgggctgcgtaggtcggttacactactaataactacgtaggaagtacggactaataacttacacgtatactntgtaggtaacgggcctatacctaacccacctacgaacggtacgaaccgaccgaaccgaactaacgtcccagtacgtaccctacgtaaacaaagtcgaaaaccgtcgaccgttagaaccgcggtaacccgtaagggaccgtaccgggtaccgttagttacgtacgtacgggtagtaacgggaactagggtaacgttaaccgggtaccgggttacttaaccggaacgttagggaaagttacggtaagtttaacg

SEQ ID NO: 44626 - DNA, 727 bp, Homo sapiens
  misc_feature: GYAE6OF02G3U99.7.85.H08.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
tcagcgtgtctctacacgaccggtgctcgatttagtatcactcagtcggcgggggctctcagagaggtcgccttagccctggattccaaggcatttccacttcggtgatcagcactagaacacagaggactcaccagtggaggttggggctgtgcgttcgggttttccttgttgcttattttagaggtgtcaatgtgngtgcagcgtgggtggngttcggtgggggagtcgtttggttcaggtccggttcggggggtcccctggacgtccttccgtccgttggtcgccgtacgtcctccgttaggttacttttaccttctaacgttacttacgtggctatacggtaacggtccgggtccgccggtacggcgtaccggaggggacgggtctggcgtaggttcgggttacacctataagtttaactcggtaggtaagtacgaacgtaacttaacgtacaacgtacgtacttaggtagtagggaaccggtaccgtacttacccgaacccgtaccgtaacccgtaagaaccggaaccggaacccaaccgaaaacgtaccctactaccgtacgttctacgtacaaacgtaacgtacgaactacgtaccgtgaacggtaccgttaggaacgggtaccgtaacgggttcgtacgttgttaacgttacgtggtacggacgtaaggtaggaccgggtcgggggtaagtaccgtacggtacggtactacggttacgg

SEQ ID NO: 44627 - DNA, 788 bp, Homo sapiens
  misc_feature: GYAE6OF02JFWYY.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgctattttagaggtgtccaatgtgaggtgcagctggtggagtcgtgggggagtcttggttcagccgtcggggggtccctggacgactctccgtgtcgctagcccttctgggtaacttttacccttgagttaaccttagtggtactagttaggaaccgttcggggttcccgaccgacgggtcccgttaccggaagggggaacgggggtctaggccgtaagggttcggggttttaccaactacgtaatttaaacgtacgttagggaaagttacgggaacctaaagttaaaccttacgaacgtaacgtaccttacgttaggtacgggaacgggtcccgtaagtttaccccaaaccccgtaaccccgtacccgtaacggtaaccggaaacccggtaaacccggaccccgtaaaacggtacccttaccgaaacctttcgggttacccttcgtaacggaactaaacgttcgaaaccgaccgtacccgtagggaaccgttacgggtaaccgaaacgggtaccgaaccgggatttaccgggttattacgtttacggtggttaccggaacgggtaagaaccggttacggaccgggggtaaggggttacctagttccggaacctggttaaccggg

SEQ ID NO: 44628 - DNA, 795 bp, Homo sapiens
  misc_feature: GYAE6OF02I4E25.7.85.H08.1.454.CMB.1.raw
  modified_base (321)..(321): a, c, t, g, unknown or other
  misc_feature (321)..(321): n is a, c, g, or t
tcagcgtgtctctacacgaccggtgctcgatttagtatcactcagtcgcggggctctcagagagtgccttagccctggattccaaggccatttccacttggtgatcagcactgaacacagaggactcaccatggagttggggctgtgtcgttgggttttccttgttgcttaagtttttagaaggtgtaccaatgtggaggtgcagcgtggtggacggtcgtgggggaggtcgtttggttcgacggccggtcggggggtcccctggacgaccgtcttccgtcggttcggcacggtcccttcgtacggtaacttttacccttntaacggtttaccttagtcgggtctatcggtaaaccgttccggggtcccgccggtacgggtcccgtaccgggaagggggtacggggtacctcgggacgttacgggtttcgggttttacaaccgtaccgttaattaaacggttacgtacgggtaaagttacggaaccttaattaaacctttaacaaaccggtacttaccgtagttacggtaacgggtaaacgggtccgtaaacttcccaaaccccggtactaccgaaggtaaccggaaccgaaccgtacccgtaaaagaccccttacgtacgttacgttaccgttactacgaacctaacgtaacgaaacctccgtacgaacgttacgggaaccgttaacgggacggtaccgtaacggtgttaaggttactttagtaaccggtgtaccggaaggtaaggacgtacgggttaccgggagggttaacttagacggtacctacgtaacgg

SEQ ID NO: 44629 - DNA, 757 bp, Homo sapiens
  misc_feature: GYAE6OF02IAQ4L.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagagactcacatggagttgggctgtgtcgttgggttttcttgttgtcttattttaggaggtgtacctaagtggtgaggtgcagtcgtaggtggaggtcggtagggggagtccgttacggttcagggtcccgggttcgggggtccctaggacgtacttccgtccgtgtacgcacgtcctcgtggttaccttttaccgttctaacgttaacttagtggaccctaagttacggtaacgttccggggtcccgaccggaccgtccggttcccgggaaagggggaacgggtcgtcggtacggtaggttcggttaccacgtacttaattaaacgtacgtaggtaacgaacgtactaaacgttaaactacaacgtaataccgtacgtaggttaggaaccggtaccgtaacgttaccacccgtaccgtaacaggtaaccgacgaacccgtacaaaccgtaacctacttacgacgttactagtacgaactaacgtagaaccaagtaccgagtaacggaaggtaccggaggaacccgaggtaacggttcttacggtacgttttacgacggttcgaaggttaaccggtaacggtaacggggtcgggtaaacgggtacggtaacctaccggtttacccggattacccggg

SEQ ID NO: 44630 - DNA, 696 bp, Homo sapiens
  misc_feature: GYAE6OF02GW1VL.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttccttgttgctattttagaaggtgtccaatgtgaggtgcagctggtggagtcgtgggggagtcttggttcaggccgtggggggtccctgagactctctgtcgcagcctgtggtactttacctcagttacttagtggctatcgaacgttcgggtcccgaccgaggcccgtcggaaggggagggtctggcgtaggttcgggttcactactattaatacgtaggtaagtacggaacctaacttaacttaacgacgtaacgtacctacgttacggtacggaaccggggtacctaccgtttacccaaccccgtaacccgtaccgtaacgggaacggtaacccggaaacccgaaccgaaaaccgtaacccgttaccgttaacgtttccggttacctaccgtaacgtaaccgtaaacgtaccgaaaccgtacgtaccgtaaggtaacggtaccggtacggaacggtaccgacggtacgttgtacgttagttacgtggtacggagtagacggtacggtacgggagggtaccgtagtacgtacgtgtaccgg

SEQ ID NO: 44631 - DNA, 656 bp, Homo sapiens
  misc_feature: GYAE6OF02F5HVN.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtggggggtccctgacgactctcctgtgcagcctcgtggtactttaccttcagttacttagtggcagtacgtaacgtcggggtcccgccgacgggtcctaccggaagggggtaacgggggtcctggcgtagggttcgggtttaccactaacgtatttaacgtacgtagggaaagtacggaacctaagtaaaccttacaactagtacctcgtaggtagggaacgggtcctaacttccaccctacctccgagaacgaccgaccgtaccaaagacctcgtaactcgtactcgtagaacctaaagtacgaactacgccgtagaggtacgtacgaacggaccgtacgggtcttggttagttaacgttcgtcggtacgcggtaagacggtacggtaccggggtaggggtaaccgtagtcggacctaagtcgg

SEQ ID NO: 44632 - DNA, 715 bp, Homo sapiens
  misc_feature: GYAE6OF02JCXKO.7.85.H08.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagcgtgtctctacacgaccggtgctcgatttagtatcactcagtcgcggggctctcagagaggtgccttagacctggattccaaggcatttccacttggtgatcagcactgaacacagaggactcaccatggagttgggctgtgctggttttccttgttgctattttagaggtgtccaatgtgaggtgcagcgtggtggagtcgtggggagtcttggttcagccgtggggtcccngagactctctgtgcagctcgngtactttccttcagttacttatagctagtgtaacgtcggtccgccgaggtccgtaccgagggacgggtctacgcgtagttcgggtttcaactactaagttaacgtaacgtagggtaaagtaacggacctaaacgttaacgtaacgacgaagtacctcgtaggtacggaacggtaccgtactttcccgaaaccctacctaccgacgtacgaaccgacccgggaacaaacgtaacctacccgtacgttaccgttccgttaccgtacgaaccgtaaaccgttacgaaaccgtacgtaccgaagtacggtacggaaccggaaggtacccgtacggtccgttacgtttacgtttaacgtttacggtacgttaccggtacggaacggtacggttaacccggggttaccgggggtaaaccgggttaacgttaacggtaacccggtaccgtaaccggtttaccgg

SEQ ID NO: 44633 - DNA, 737 bp, Homo sapiens
  misc_feature: GYAE6OF02I1SE9.7.85.H08.1.454.CMB.1.raw
  modified_base (348)..(348): a, c, t, g, unknown or other
  misc_feature (348)..(348): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttgggctgtgctggttttctgttgctatttgagtgtcaatgtgaggtgcagctggtggagtcgtgggggagtcgttggttcaggtccggtcggggggtccctggacgtactcgtcctgtcgcacgcctcgtggtacttttaccttcagtacttatggctatcggaacttggggtccgccgacggccgtacggaggggaacgggctggacgngggttcgggtttacaccgtaataatttaaactacgtacggtaaaggtacggtaaccgtaacttaaacgttaacaaccgtaagtacctacgtttacggacggtaaaccggggccggttaacttcccgtaaccccgtaacccgttaccgtacgaaacggtaccggaacccgtaaccgaaacgaaccttaccgtaacgtcggttacccttacttacggacctaaacgtacgtaaaccaggtcccgtaaggtaacggtacgtaccgggaacggtaaccgtaacgggtcttggtacgtttaacgttaccggttggtacgaacgggtaacggtaccggaacggttaccgggggtaaggggtaaccggttagtacccggtaccgtcgttaacgggg

SEQ ID NO: 44634 - DNA, 768 bp, Homo sapiens
  misc_feature: GYAE6OF02F9AE4.7.85.H08.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagcgtgtctctacacgaccggtgctcgatttagtatcactcagtcgcgggggcgtcgtcagagaggtgccttagccctggattccaaggcatttccacttggtgatcagcactgaacacagaggactcacatggagttgggctgtgcgtgggtttccttggttncttatttagaaggtgtccaatgtggagtgcagctggnggagtcgtagggggagtcgttggtcgngtccggtcgggggtccctggacgtacgtcgtccgtgtcgcacgtcctgtcggtacttttaccgttcgtagttacgttagtcgggtactaacgtcggtaacgttccggggtccgacccggtaacggtcccgtaccggggaaggggtaaaccggggtcctttacggaggttacggtttaccggggtttacaacgtaaccgttaagttaaccgttaacgtagggtaaacgtacggtaaaccgttaataaaccgttacaacgaacgttaacgtcgtagtaacggtacgggactacgttaccacccgaccttacgaacggacgtaaaccgacggaaccaaacgtaccgaccttaacgccgttaaccgtcttaaccgaacgtaaatcgggtaaaccacggtactacgtaagacgttaaccgggagacgtttacccgaggttaccttggtaaacttcggttcggacgaccgggtaaaggacggttagggaccccggggtaaggggttaaaccctacgtacgggtaaccccttaagtaacccgggg

SEQ ID NO: 44635 - DNA, 763 bp, Homo sapiens
  misc_feature: GYAE6OF02HR104.7.85.H08.1.454.CMB.1.raw
  modified_base (592)..(592): a, c, t, g, unknown or other
  misc_feature (592)..(592): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcttggttttccttgttgctattttagaaggtgtccaatgtgaggtgcagctggtggagtcggtgggggaggtctttggttcacggccgtggggggtccctgacgctcctccgtgtgccagccttcgtggtattttacccttctagttacttatcgggctatcggtaacgttcggggtccccgaccgtaggccgttacccggaagggggacggggtccgttggacgtagggttcgggttttaccaacgtacctaatttaaacgtacggttaggggtaaaggttaacggtacctaaattaaaccttaaccgaacgtaacgtacttacgtaggtaagggaaccggggaccctaatttacccacccctaacccgttaccgaacggtacggaaacccgacccgaaccgaaacgtaaacctcttaactcgttacctcgtacgactaaacgngaaaccctcggtacccgtaggaccggtagtaccgggaacgaccggaggtaccgttagggttacgtttaacggtttacgtgggttaccggtacggaagggtaacggttaaccgggttaccggggggaaggggtacccgtttacggtaaccgggtacctaggtttacccgggg

SEQ ID NO: 44636 - DNA, 638 bp, Homo sapiens
  misc_feature: GYAE6OF02IYACV.7.85.H08.1.454.CMB.1.raw
  modified_base (477)..(477): a, c, t, g, unknown or other
  misc_feature (477)..(477): n is a, c, g, or t
  modified_base (519)..(519): a, c, t, g, unknown or other
  misc_feature (519)..(519): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgctattttagaaggtgtccaatgtgagtgcagctggtggagtcgtgggggaggtcttggttcagccgtggggggtccctgacgctctcctgtgcagcccttcgtggtacttttacccttcgtaagttacctttatcggactatagtaacgtcgggtccgcccgaggtcctacggaggggaagggctggcgtacggttggttacaccgtactattaaacgtacgtaagggaaagttacggaacctaagttaacttaacacgtagtacttcgtgaggaacggccgattacccaccaccctcgagaacgaccgtacnccgaaacaccttcactgttaccgtcagaccaagacaaccacnccgttagacggttagacggacgtaacgacggtcttgtaccgttattaccgtaggtgccggaaggtacggtaaggtccccgggggaagggtaacgttacggtacggtaaccaggttacgg

SEQ ID NO: 44637 - DNA, 799 bp, Homo sapiens
  misc_feature: GYAE6OF02JEZJ4.7.85.H08.1.454.CMB.1.raw
  modified_base (693)..(693): a, c, t, g, unknown or other
  misc_feature (693)..(693): n is a, c, g, or t
tcagcgtgtctctacacgaccggtgctcgatttagtatcactcagtcgcgggggctctcagagaggtgccttagacctggattccaaggcatttccacttggtgatcagcactgaacacagagactcaccatggagttgggctgtgcttgggtttccttgttagcttatttagaaggtgtcaatgtgaggtgctagctggtggagtcgtgggggaggtcgttggttcaggtccggtcggggggtccctggacgtacttccgtccgtgtcgcgacgtcccgttcgtacggtaacttttacccttcgtaacgttaccgttaagtcgggtcaagttcgaacgttcgggtccgtaccgtacggtcctaaccgggaaggggaacgggtccgttacggcgtaagggtttcggttacaacgttaactaacttaaacgtacggtaagggtaaacggtacgtaaacctaagttaaaaccgttacgtaaacgtacgtaccgttacttacggtaacggaacgggtacccggttacttacccggaaccctacccgttaaccgacggtaacggaaccgaccgtaaccgtaaacgaacccttccgaaccgttagttaccgtccgttacgtaaacaagttaaccgtaacgtaccgtacgtaacgagtaaccgggtaccgaaacgggtaccgaccggtacgtttaacgnggttttaacgttaccggttcggtaacgacgggtaacggtaacggtacggtacccgggggtaaggttaccccggtaagtaccgggttaaccctaggtttaacccggg

SEQ ID NO: 44638 - DNA, 649 bp, Homo sapiens
  misc_feature: GYAE6OF02FYO91.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtgggggtccctgagctctcctgtgcacgcctctggtactttaccttcagttacttagtggacatgaacgtcgggtcccgccgaggcctccggaggggaacggggctggcgtaggttcgggtttacacgtaactattaaactacgtagggtaagtacggaacctaataaacttacaacacgtacttacgtaggtacggaacgggaccgtacttacccaccctaccgtaccgaacggaacgaccgaaccgacccaaacgaacccttcaactcgttacctctacggactaaatacgaaccgagtccgtaggacgtcgtaacggaacgacgacgggtcttaggtagttacgttacgtcggtacggtacggaaggtacgacggtaccggggtaagggtaccgtagtaccggaccgtagtacgg

SEQ ID NO: 44639 - DNA, 693 bp, Homo sapiens
  misc_feature: GYAE6OF02I0W92.7.85.H08.1.454.CMB.1.raw
  modified_base (268)..(268): a, c, t, g, unknown or other
  misc_feature (268)..(268): n is a, c, g, or t
  modified_base (611)..(611): a, c, t, g, unknown or other
  misc_feature (611)..(611): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctggttttctgttgctattttagaggtgtccaatgtgaggtgcagcgtggtggagtcgtgggggagtcttggttcaggtccgtcgggggtcctaggagtacctctcctgtgccgagcctntacggtatttaccgttcgagttacttagtcggactatcggtaacgtcgggttaccgaccgagggtcctaccggaagggggtacgggtctcggtacgtagggttacgggtttacaccgtaataacgttaaagttcggtacgggtaaacgttacggaacctaacttaaaccgttacgaactaggtaacccttgtacggtacgggtaacggcctacgtttaccaaccccgttacctccgaacgaaccgacgaacccgtacgaaaccgtactcgtaacgtcgtactcgtacgactaaacgtagaacgtacgtcgtacgacgtacggtacgacggttaacggccggtnttaggtcgtacttacggtcggtacgagtaccggtagtaccgggtcgggtacgggtacctaggtacgtaccggtagttaccgg

SEQ ID NO: 44640 - DNA, 857 bp, Homo sapiens
  misc_feature: GYAE6OF02G03V0.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtgagtcgtgggggaggcttggttcagccgtggggggtccctggacgactctcctgtcgcagcctctggactttaccgttcacgtacttatggtacctatggtaaccgttcgggtacccgccgtacgggaccgtcccgaaggggtaaagggggtccgtggtccgaagggttcggggttttacaaccgtaactacgtttaaacgtacgtacgggtaaaggtaacgggaaccctaacgttaaacgttaacaaaccaaggtaacccttacgtaggttaacggaacgggggtaccccgtaacgtttacccgaaccccgtaaaccccgtttacccccgaaacgggtaaacggaaacccgaacccgggtaaaccccgtaaaacccggtaaacccgttacccgtaaacccgttcgggttaaacccttcccggttacggttaaaccctaaaagttacggaaaaccgaaccggtaccccgttaagggtaaccggtacggggtttaccggaaacggggtaaccgtaaccggggtaccgttaaccggggttagttaaccgtttaaccggttacgggtacgtaccgggtaacggtaacggtaacggttaccccgggggacggggggtaaccgtaacgggtttaccggtaacccgtacggtttaaccggg

SEQ ID NO: 44641 - DNA, 760 bp, Homo sapiens
  misc_feature: GYAE6OF02HZLAV.7.85.H08.1.454.CMB.1.raw
  modified_base (242)..(242): a, c, t, g, unknown or other
  misc_feature (242)..(242): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggcttggttcagccgtgggggtcccngagctctcctgtgcagcctctggtacttttaccttctagttacttagtggctaagtggtaacgtcgggtacccgccgacggtccgtacccggaggggaacggggtctcggcgtaggttcgggttaccactaactaacttaaactacgtagggaacgtacggacctaattaaccttaacaacgtaagtacttacgtacggttagggaacgggtacctactttacccgaaccctaaccccgttaaccgaacgggtaacggaacccggaaccgacccgaaaacggtaacccttcctaaaccgtttcgttacccttaccgtacgtaaaccgtaaaacttaccggaaaccgtacggtacccgtagggaaccggtacgggtaaccgtaacggggaacctaccgggtctttaggttaccgtttaacgtttaccgtgggtttcggtaaggaaggttaacggtaaacggtttaaccccggggtccgggtttaaatacccggtttaaggttagggtaacgttaacggg

SEQ ID NO: 44642 - DNA, 774 bp, Homo sapiens
  misc_feature: GYAE6OF02G2Y9E.7.85.H08.1.454.CMB.1.raw
  modified_base (693)..(693): a, c, t, g, unknown or other
  misc_feature (693)..(693): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgtcttattttagaaggtgtaccaatgtgaggtgcagcgtggtggagtcggtgggggaggtcttggttcaggtccggtcggggggtccctgacgtactcctccgtgtcgcacgtcctcgttacggttacttttaccttcagttaaccttaggtcggacttagtacggtaaccggttcgggtaccccgacggtaccgggtccgtaccgggaacggggggtaacgggtccgttcggtacggtacgggtttcgggtttaccactaaacgttaatttaaaccgtacggtagggtaaacgtaacggtaacctaaacttaaaccgtaacgaaccgtacgtactcgtaggtacggaaccgggtaccgtactacccgaccctacccgtacgaacggacgtaccgaccgaaccgaacgtacctacgtaacctcgttaacctcgtaacgaactaaacgtcgaaaccgtacgccgtaaggacggtaacggttaccgaaacggtaccgtaaccgtgttacggttacgttagtttacccggnggttacggaccggtaaggaccggttaaccggtaccgggggtaacgggtattaaccggacgttaaccggtagttaacccggg

SEQ ID NO: 44643 - DNA, 634 bp, Homo sapiens
  misc_feature: GYAE6OF02G5YZV.7.85.H08.1.454.CMB.1.raw
  modified_base (267)..(267): a, c, t, g, unknown or other
  misc_feature (267)..(267): n is a, c, g, or t
  modified_base (496)..(496): a, c, t, g, unknown or other
  misc_feature (496)..(496): n is a, c, g, or t
  modified_base (523)..(523): a, c, t, g, unknown or other
  misc_feature (523)..(523): n is a, c, g, or t
  modified_base (541)..(541): a, c, t, g, unknown or other
  misc_feature (541)..(541): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttatttagaaggtgtccaatgtgaggtgcagtctggtggagtcgtggggaggcttggtcagccgtcggggggtccctgacgactctcctgtgcagtcctntgtactttacctctagttacttagtcgctagtacgacgtcgggtcccgccgacggccgtccggaaggggaacgggtctacgccgtaggttcggttacacgtactaattaacgtacgtaggaagtacggaactaattaacctaacacagtactcgtaggtacggtacgggacctacgtacccacccgtaacctccgaaaggacgaaccggacctaacggaaactaacccnctacgtcttccgtactaacgaactaanaccgtaagacgtcgtaanacggacgacgtaacgaccgtacggtaccttagtctacgttggtacggagaaggtaatacggtacgtacgtataccggtactaggataggtacg

SEQ ID NO: 44644 - DNA, 839 bp, Homo sapiens
  misc_feature: GYAE6OF02GXBOF.7.85.H08.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctattttagaaggtgtccaatgtgaggtncagctggtggagtcgtgggggaggtcgttgggttcacgccgtcggggggtccctgacgactctcgtgngcagcctcgtggtacttttaccttctagttacttagtggctagtacgtaacgtcgggtccgccgacggtccgtaccggagggggaaggggtctggacggttaggttcgggtttacaacgtactaattaaacttaacggtagggtaaaacggtacgggtaaacctaaacgtttaaaaccttaaccgtaaacgtaccgtaacgttccgttagggtaacgggtaaaccggggtaccgttaactttaaccccgacccgtaaccctaccggaacggtaacggaaacccgaaccggtaacccaaaaggtaaccctaccgtaccgttaccgttccgtaccgttacggaaactaaaaccggtttagaaaccgtaccgggtaccctaaggggtacggtaaccgggttaaccggggaaacgggttacccggaaaccgggttcgttaacggttttcggtttaaaccgtttacggggttacgttacggggtaacgggtaaagggtaccgggtaaccggggtttaaccccgggggggaaggggttaaaccccgttaaggtaacccggtaacccgttaccggttaccggg

SEQ ID NO: 44645 - DNA, 764 bp, Homo sapiens
  misc_feature: GYAE6OF02FLGVT.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggagtcgtgggggaggtcttggttcagccgtgggggtccctgacgtactctccgtgtgcacgcctcgtggtactttaccttcaagttacttagtggactagtcgtaaccggtcgggtcccgaccgaggtccgtaccggaagggggaacgggtcttggaccgttagggttcgggtttaccaacgtacgtaaactttaacgtaacggttagggtaaacggttaaccggtaacctaaagtttaaaaccttaccgaaacgtaacgtaacgttacgtagggttaacgggaaccggggtaccttaacgttaccccgaacccgttacccccgaaccgtaaggaacccggtaacccgaaccgtaaacccgaaacgtaaccctacctaacgttcgttccttaccgaaccgtaactaaagttaacgaaccgacggtacccgtagaaaccggttacgggaccgaacgggaaacctccgggttagttcgtacgtttaacgttccgtagggtacggaccggtaagaacggtaccggaccgggggtaggtaaccttaggctaccgtagtcccgg

SEQ ID NO: 44646 - DNA, 646 bp, Homo sapiens
  misc_feature: GYAE6OF02FQHKA.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtcgtgggggaggtcttgggttcacggccgtgggggggtccctgacgactctcctgtgcagtcctctggtatttaccttctagttacttatggactatgtaacgtcgggtccgccgacggcctccgaggggaaggggctgcgaggttgggtttacacactaattaatactagaaggtaggaaccaattaacttacaactacgacttcgtaggtacgaacgggccgactttaccgaccctacctaccaggacgaccggtaccgaaccgtaacgaacctcgaacttagtccctacgtagactaaagtacaaccgacgcgtacgaagcgggtaacgacgggaaccgtacggacgttgttacggtactttacggtggtagtaccgggtagacgtaacggtcccggggtaaggggtacccgttaaggtcggaacctagttaacggg

SEQ ID NO: 44647 - DNA, 684 bp, Homo sapiens
  misc_feature: GYAE6OF02FMPDG.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagctggtggagtcgtgggggaggtcttggttcagccgtggggggtccctgagctctcctgtgcagcctcgtggtactttaccttcagttacttagtggctatgaacgtcgggtccgccgaggcctccggaggggacgggctggcgtaggttcgggtttacaactacgtaattaacgtacgtagggaacgtacggaacctaagttaaccttacacgtaacgtacttcgtaggtacggaacgggtcctaagttcccgaaccctaacccgtaccgaagaacgaccgtaaccgaccctaaaggtacctctaacgttcgttcctacgtcgaaactaaatacgaacgtaccgtccgtaaggacgtaaggtaccggaaacggacccgtagggtacctttagggtaccttagtttacggttggacggtacggtaacggaacggtaccggtaccgggggaacgggtacgttacgtacggtacccgtgttaacccgg

SEQ ID NO: 44648 - DNA, 672 bp, Homo sapiens
  misc_feature: GYAE6OF02JTJBP.7.85.H08.1.454.CMB.1.raw
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
  modified_base (572)..(572): a, c, t, g, unknown or other
  misc_feature (572)..(572): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctggtttccttgttgctatttagaagtgtccaatgtgaggtgcagctggtggagtcggtgggggaggtcgttggttcaggtccgtcggggggtccctaggacgactctcctggtgcagcctcgtagtactttaccgttcagttacttanacggtctatcgaacgttcgggtccgcgacggcctaccggaggggaagggtccgtggccgtaggttcgggttacacgtactaagttaacgtagtacgggaatacggtaccgtaactaaaccgtanaacgtagacgttacgtgtaacgggaacggtaccgtcgtaccaacccgtacctaccgaacgtacgtaaccggacctaaccaaacgtaacctactaccctttagcccttacgtaacgtacaaaacgtaacgtaacacggttccgaaggaaggngttaaccgaacggcgaaccgtacgtgttaccgttagttacgtcgtcggacggaacgaggtaacccgtgggggtacgacgttagtacgaccttaggtaccg

SEQ ID NO: 44649 - DNA, 701 bp, Homo sapiens
  misc_feature: GYAE6OF02J0OHB.7.85.H08.1.454.CMB.1.raw
  modified_base (626)..(626): a, c, t, g, unknown or other
  misc_feature (626)..(626): n is a, c, g, or t
  modified_base (647)..(647): a, c, t, g, unknown or other
  misc_feature (647)..(647): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctgggttttccttgttgcttattttagaaggtgtccaatgtgagtgcagctggtggagtcgtgggggagtcttggttcagccgtgggggtcctggacgacttctctgtgcacgcctctggtactttacctctagttacttatggctagttcgaacgtcggggtcccgacgaggccgtaccggaaggggtaacggggctcgcgtagggttcgggtttaccactaactaattaacgtacgtagggaaacgttacggacctaagttaaacttaacgaactagtacctacgtaggtaggaaccgggacgtacttaccgaaaccccgtaccttacccgaaaggtaacgtaacccggaaccgtaacccgaaaaaggtaccccttacgttaacgtcgtttacgttaccgtagaaccctaaaaagttcggaaaaaccgttggtccctaaggaacggtacgttccgggaaacgtacgaacccgggttnttacggttagtacgtttacgnggtacgagtaacggaggttacggcgggtaagggtacctacgacggtaccagtcg

SEQ ID NO: 44650 - DNA, 847 bp, Homo sapiens
  misc_feature: GYAE6OF02H2N77.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcacatggagttggggctgtgcgttgggttttccttgttgcttattttagaggtgtccaatgtgaggtgcagcgtgggtggtagtcggtagggggagtcgtttggttcgaggccggtcggggggtccctggacgtacctctcctggtgccccccagtcccttcgtacggttaacttttacccttacgtacgtttaacttagtggtactagttacggaaccggttcggggtaccccggtccgacgggtccgttacccgggaaaggggggtaacggggtccgttaggtaccgttagggtttccgggtttaaccaaccgtaaccttaattttaaacgtaacggttaagggtaaacggttaacggaacctaaacgtttaaaaccttaaccaacgtaacgtaaccgttacggttaggttaacgggaaccggggtaccttaacgttaccccaaccccgtacccctaaccgaagaaacggaacccggaaccgaaccaacggtaaaccttcctaacccgtttcggttacctaccgtacgaaaccctaaaggtaccgaaacgtaccggtaccgtaagggaaacggtacgggtaaccgggaacgggaaccgtaccggggttcgtttaggttacgtttacgttacgggtggtacggtaacgggaaggtaacggttaccgggtaccgggggtacgggttacggttaacgtaccggtaccgttacggttacggg

SEQ ID NO: 44651 - DNA, 797 bp, Homo sapiens
  misc_feature: GYAE6OF02G2Y03.7.85.H08.1.454.CMB.1.raw
  modified_base (219)..(219): a, c, t, g, unknown or other
  misc_feature (219)..(219): n is a, c, g, or t
  modified_base (723)..(723): a, c, t, g, unknown or other
  misc_feature (723)..(723): n is a, c, g, or t
tcagcgtgtctctacacgaccggtgctcgatttagtatcactcagtcgcggggctctcagagaggtgccttagccctggattccaaggcatttccacttggtgatcagcactgaacacagagactcacggtggagttgggctgtgcgttggttttccttgttgcttatttagaaggtgtaccaatgtgaggtgcagtcgtggtggagtcggtagggggngtcttggtcgacgtccggtcggggtacctggacgtcttcgttcctggtcgacgtacgtccttcgtacggttaacttttaccgttataacgttacgtttagtcgggtactaagttacggtaaccggtcggggttaccccgacccggtaacggtcccggtaaccggtaaggggggaacggtccgcgtacggtacgggtttcggttaaccgaactaacgttaattaacgtacgtaacggtaaacggtaacgaacctaaagttaaccgttaacaaccgtagtaccgttaggaggtacggaaccggcgttaaccttacccggaacccctaaccgtaccggaaacgtaacggaacccgaccgtaaaccaacgtaaccgtcctaacggttcttccgcgtaacgaacgtaaactcgaaaccgacgttaccgagggtaaccgtagtaaccggacgtaaccggtacggtacgttacgttaacgttacgttaaccgttgggaaccgtaacgggtntaaaccggggttccgttacgggggaaccggttaacttaccggaacggtacttacccggtagtttaaccccgggg

SEQ ID NO: 44652 - DNA, 726 bp, Homo sapiens
  misc_feature: GYAE6OF02JCUAB.7.85.H08.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
tcagcgtgtctctacacgaccggtgctcgatttagtatcactcagtcgcgggggctctcagagaggtgccttagcccctggattccaaggcatttccacttggtgatcagcactgaacacagaggactcaccatggagttgggctgtgctgggttttccttgttgctattttagaaggtgtcaatgtgaggtgcngctggtggagtcgtggggnggtcgttggttcagccgtgggggtccctgagctctcctgtgcagcctcgtgtactttaccgtactacgttacttgtcggctatacgtacgtcgggtcccnccgtacggccgtaccgaggggacgggtcngcgtaggttcgggttacacgtacctagtttaacgacgtagggtaaacgtacggtaacctaacttaaacgttaccgaacgtaccgtacgttaccgttaggtacgggaaccggtaccgtacttacccgaaccctacccgtacgaacgtaccggaacgacccgaaccgtaacgtaaccgtaccgaactttacgtccgttaccgtacgaacccgtaaagttaccgaaaaccgtccgttaccgtaggtaaccggttcgggaaacggaacccggtaaaccggtcggttacgttcgtagttaccgttaacggtttcggaactacgggaacgtaaggtccgggtaccggggtaacgggtaccttaacggtacctaccgtaagggttccccg

SEQ ID NO: 44653 - DNA, 650 bp, Homo sapiens
  misc_feature: GYAE6OF02I86W0.7.85.H08.1.454.CMB.1.raw
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
  modified_base (554)..(554): a, c, t, g, unknown or other
  misc_feature (554)..(554): n is a, c, g, or t
  modified_base (580)..(580): a, c, t, g, unknown or other
  misc_feature (580)..(580): n is a, c, g, or t
  modified_base (589)..(589): a, c, t, g, unknown or other
  misc_feature (589)..(589): n is a, c, g, or t
  modified_base (643)..(643): a, c, t, g, unknown or other
  misc_feature (643)..(643): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcgttgggttttccttgttgtcttattttagaaggtgttccaatgtggaggtgcagcgtgggtcggagtcggtgggggaggtcgtttggttacgnggccggttcggggggtcccctaggagtacctctccgtgtcgcgacgtcctcgtcggtactttacctcgagttacttgacgcngtacgaacgtcgggtaccnccgacggcctacggagggtacgggctcggacgtggttacgttacgaactcgtaagttaacttacggaggtaacggtacggaactaattacgtaacaacgtgaccttgtacgaggtaacggcctaagtcccaacccgtcctaagacgtacgaccgacggaaccaagtaccaactacgtcttcgacgagacctaaagtcgaacgtcgaccgtnaacggtcgtacgtaacgacgaccgtntaccggttntaacggtactggaccgttaggaatcggaccggtcggaaggacttgacgtaccgngttacgg

SEQ ID NO: 44654 - DNA, 576 bp, Homo sapiens
  misc_feature: GYAE6OF02IWJMY.7.85.H08.1.454.CMB.1.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (454)..(454): a, c, t, g, unknown or other
  misc_feature (454)..(454): n is a, c, g, or t
  modified_base (500)..(500): a, c, t, g, unknown or other
  misc_feature (500)..(500): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcacatggagttgggctgtgctgggtttccttgttgcttatttagaaggtgtccaatgtgaggtgcagngtggtagggagtcggtgggggagtcgttggttcaggcgttggggggtcccngacggtctctcctgtgcagcctcgtgtattactnagtactgtggcatgactggcncagtcncgagggnggcagcgtaggttggtcagactataactagaggaacgtagaccagtaactacgacanactcgtagagacgggctactacgaccncgtacaggacgaagcgaacctaaggaccttcgacttcggtactcgtacgataaagngaaaccgcgtaccgtagaacggtacgacgtaaccggacgttaccgngttagtagttaacctggtccgtgaacgtaggtaacgcgggtaccgggagggtaccctaggtcgaccgtattacggg

SEQ ID NO: 44655 - DNA, 662 bp, Homo sapiens
  misc_feature: GYAE6OF02GJV3I.7.85.H08.1.454.CMB.1.raw
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggttgtgcttgggttttccttgttgcttattttagaaggtgtccaatgtgaggtgcagcgtggtggaggtcgtgggggaggcgttggttcaggccgtcggggggtccctgacgactctcctgtgcacgcctctggtactttaccttctagttacttagtggctagtgaacgtcgggtccgccgaggccgtaccggagggggaacgggctggcgtacggttgggttacaactaacgtaattaaactacgtaggaaaggttaacggaacctaagttaaacttacaccgaagtacctgtaggtaggaaccgggtaccgtattacccaacccgtacctaccgaaggacgaaccgaaccgacctaaagaccctaccgtaacgttcgtacctagtacgaaacctaaagtaccgaactcgacgtaggacgaggtccggaagaaccncggtnttgtaacttagttacgtggtaagacggaagcgttaacgggacccgggaggtacgtagaccgtactagtccgtaacgg

SEQ ID NO: 44656 - DNA, 721 bp, Homo sapiens
  misc_feature: GYAE6OF02HBWAM.7.85.H08.1.454.CMB.1.raw
  modified_base (638)..(638): a, c, t, g, unknown or other
  misc_feature (638)..(638): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcgttgggttttccttgttgcttattttagaaggtgtccaatgtgaggtgcagtcgtggtggagtcgtgggggagtcgttggtacagccggtgggggtccctaggacgtactcctccgtgtcgctacgtcctcgttacggtactttacctctaacgttacgttagtcggctacgtacgtaaccggtcggggtacccgtccggacggtccgtaccgggaagggggaacgggtctggacgtaggttcgggtttacaacgtactaagttaaactacggtacggaagtacgaactaattaacctaagacgactacgtacgtaggtacgggaacgtaccgttactaccccgtaacctacccgtaccgaaggtaaccggaccggaacccgaacgtaaaacgtacccttacgtacgtagttacccgtactacgaaacctaagtacgaacctcgtacgtacggtaaggtaccgtacggaacgccgtaacgtagtttcgtnttaccgttaagcggtcgtaccggaagtaccgggtacgggtaccggggttaggaacccgttcggtaacgtaccgttctaccggg

SEQ ID NO: 44657 - DNA, 839 bp, Homo sapiens
  misc_feature: GYAE6OF02IEW4E.7.85.H08.1.454.CMB.1.raw
tcagcgtgtctctacacgaccggtgctcgatttagtatcactcagtcggcgggggctctcagagaggtgccttagccctggattccaaggcatttccacttggtgatcagcactgaacacagaggactcaccatggagttggggctgtgcgttgggttttccttgttgcttattttagaaggtgttccaatgtgaggtgcagctggtggagtcgtgggggagtcgttggttcaggtccgtggggggtccctaggacgactctcctggtgcacgtcctcgtaggacttttaccgtctacgttacttagtacggtacctagtacggtaaccgttcggggttaccccgaccggtaacgggtccgtcccggaaggggaacggggtccgtaggtccgtaggttcggtttacgactacgtaacgtttaataccgtagggtaaacgtacggaacctaaacgttaaaccgttaaccaactaaggtaccctttacgtacgggtacgtaacgggggtccctaacgtttacccgaacccctaccccgttaaccgaacggtacggtaaacccggaccggaacctaaacggtaaaccttcccgtaaaccgttcggttaccgttaacccggttagtaaacccgtaaaacgttacggaaaacccgtagggtaccccgttaggggaacggttaacgggttaccgggaaacgggtaccggaaccgggttaccgtttacggttacgtttaaccggttttaacggtcgggtaaccgggtacggtaacgggtaacggtccggggtaaccggggggtaacgggtaccggttaaagttccggaaccgttacgttaacgggg

SEQ ID NO: 44658 - DNA, 782 bp, Homo sapiens
  misc_feature: GYAE6OF02GJ2BG.7.85.H08.1.454.CMB.1.raw
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagcgtggtggagtcgtgggggaggtcgttgggttcgacggtccgggtcgggggttcccgtggacgtacctccgtccgtggtcgcgacggtccttcgtacggttacttttaccttctacgttacttagtggtactagtacgtacggtccgggtccgaccgtacggcccgtaccgggaaggggacgggtcgtaggtacgtacgggttagggttcaaccgtaacgtaagttaaacgttacggtaagggtaaacggtaacggtaacctaaacgttaaaccttaaccgtaactaacgtacgttacgtacgtaacgggaaccgggtacttaaccgtacccgaacccgtaacccgttaaccggaaggaaccggtacccgaaaccggtaacccgaaaccgtaccttccgtacttacggtctaccgtacaaactaacgtacgaactacggtaccgtagggaaccggtaaggaaccgtacggtaaacgacgggttacgttggttaacttccgtttaaggtggtaccggtaaggaacggttaacggtaccgggacgggggtaccggttaacggtaggccgtaacgtcggttaaccggg

SEQ ID NO: 44659 - DNA, 751 bp, Homo sapiens
  misc_feature: GYAE6OF02FS4YY.7.85.H08.1.454.CMB.1.raw
  modified_base (673)..(673): a, c, t, g, unknown or other
  misc_feature (673)..(673): n is a, c, g, or t
  modified_base (701)..(701): a, c, t, g, unknown or other
  misc_feature (701)..(701): n is a, c, g, or t
  modified_base (742)..(742): a, c, t, g, unknown or other
  misc_feature (742)..(742): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcgttgggttttccttgttgcttagttttagaggtgtacaatgtggagtgcagcgtggtcgagtcggtggggtagtcgttggttctacgccggttcgggggtacccttgacgtacttccgtccgttggtcgtcacgtcccgtctacggttactttaccttaccgtagttacttagtgtacgtacgtacgtaacgtccgggtaccgccggtacgtccgtccgggaaggggttacgggacgtcggacggtttaggttaccgggtttcaacgtaaacgttacgtttaaacgtacggttaacgggtaaacggttacggaaaccctttaaacgttaacgtttaaccaacgggtaactacgttacgtacggtagggaaccggtacgtactttcccaaccgtacccgtacgaaccggtagtaacccgaccggaacctaaccgaacgttccaaccgttcgttactcggtactaaactagtaccggaactaggtccgtaaggacgggtaccgtaacgaccgtacgaaccgggttntacggttattacgttacgtggtaaccgngggtaacgtaggtacgtacggggacgttacgctaccggtanaccgttcgg

SEQ ID NO: 44660 - DNA, 705 bp, Homo sapiens
  misc_feature: GYAE6OF02G58OX.7.85.H08.1.454.CMB.1.raw
  modified_base (582)..(582): a, c, t, g, unknown or other
  misc_feature (582)..(582): n is a, c, g, or t
tcagcgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaggtgtccaatgtgaggtgcagcgtggtggagtcgtgggggagtcgttggttcaggccgtggggggtccctggagactctcctgtgcagcctcgtgtactttacctcagtacttagtcggactagtaggtaacgtcggggtccccgaccgtacggggtccgtaccgggagggggtaacggggcttcggaccgtagggtttcgggtttaccactaactaattaaacgtacgtagggtaaacgttacggaaccttaagttaaaccttacaacgtaacgtacgtcgtaggtaacgggaacgggtccttacgttacccacccgtaacccgtaacgaacggaacgtacccggaaccaaccgtaaaccgactccgttaaccttcggtaccttcgtagaactaaacgtcgaaacncgtaccgtagacgtacgtacggacggacacggtacttaggtacgttacgttacgtgggtacaggaccgaagggtccggtaaccggggagggttaacctaggtaccgtaaccgtagttaccggg

SEQ ID NO: 44661 - DNA, 733 bp, Homo sapiens
  misc_feature: GYAE6OF02HCZTQ.7.85.H08.1.454.CMB.1.raw
  modified_base (562)..(562): a, c, t, g, unknown or other
  misc_feature (562)..(562): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcacatggagttgggctgtgtcttgggtttttccttgttgcttattttagaggtgtcaatgtggagtgcagctggtggagtcggtgggggaggtcgtttggttcagtccggtcgggggttccctggacgtcctccttccgtgtcgccacgtccctcgtggttaactttaccgttactacgttacttagtgactagttagtacggtaccggtcccgaccgagggtccgtaccggaagggacgggctggacgtaggttcgggttacaacgtactaagttaatacggtaacggtaagtaccggaaactaacgttaaaaccttacgaacctaacgtaccgttcgagggtacggaaaccgggtcctaacttcccgaaccctcccgtaggaacgacggaaccgaccgaaccgaaacgtaaccctacgtaacgttcgttaccncgttacgaaacgtaactaacggaaacctacggtaccgtagtaagaccgttaacgacggtaacccgaacgtgttaccggttagttaaccgttacgtggtacgaaccggtagggtaaccggtaccgggacggggttaacgggtcttaacccggtacgaccgtagtttaaccgg

SEQ ID NO: 44662 - DNA, 772 bp, Homo sapiens
  misc_feature: GYAE6OF02F196D.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcgttgggttttccttgttgcttattttagaaggtgtccaatgtgaggtgcagctggtggagtcgtgggggaggtcgttggttccgaggtccggtcgggggtccctggagacctcgtccgttgtcgtacacgtcccttcgtcggttacttttaccttaccgtacgttaacgtttagtcgggactagttacgtaacggttccggggtaccccgcgtaacggtccgtacccgggaagggggacggggtctcggacgtacgggtttgggtttaccacgtacctaagttaactaagtaggtaagtacggaaaccttaacgttaaaccgttacaaccgtacgtaaccttcgtacgggttaacgaacggggtccttaaccgttaacccgtaccccgacccgttaccgaaacggtaacccgaaccggtaccgaaccgaaaccgtaacccgtactacccgttactaccgttcctaacgggtacctaaacggttaccgtaacgaccggtccgtaacggacggttaccggtacggaacgtacgtacgtccgttagtacgttagtacgttggtacgaccgtaggtaacggacggttaccgggtaacgggtaccgtggtaccggtaactagttaccgg

SEQ ID NO: 44663 - DNA, 655 bp, Homo sapiens
  misc_feature: GYAE6OF02HQVE4.7.85.H08.1.454.CMB.1.raw
  modified_base (178)..(178): a, c, t, g, unknown or other
  misc_feature (178)..(178): n is a, c, g, or t
  modified_base (591)..(591): a, c, t, g, unknown or other
  misc_feature (591)..(591): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgtgcttatttagaggtntccaatgtgaggtgcagcgtggtggagtcgtgggggaggtcgttggttcaggtcccggtgggggtccctggacgtaccgtctcctgtgccgacgtcctctaggtacttttaccttacagttacttagtggctataggtaacgtcgggtccgtaccgaggcctacggagggacggtctcgtcgtaggttgggttcaactactattaacgtacgtaggaagtacgaacgtattaacctaacacgtagactcgtagtaggtaacggccgattaccacctacctccagacggaacgtaccgaactaacgaacctacgtcgtactcgtacgtacgaactaagtaacgaacctaacgtccgagtaacgaacgttaccgaacgggaccgtacgggtacgttaggtacgttaacgttacgnggttaccggaggtaacgagggtacggtaccggggagggtactaacggtacgtactagtacccgg

SEQ ID NO: 44664 - DNA, 821 bp, Homo sapiens
  misc_feature: GYAE6OF02H24XH.7.85.H08.1.454.CMB.1.raw
tcagcgtgtctctacacgaccggtgctcgatttagtatcactcagtcgcgggggctctcagagaggtgccttagccctggattccaaggctatttccacttggtgatcagcactgaacacagaggactcaccatggaggttggggctggtgtcgttgggttttccttggttgtacttagttttaggtaaggtcgtacctaagtggtagtaggtgcgtagtcgtgggtggtaggtcggtagggggagtcgttggttacgacggtccggtcgggggtccctaggacgtaccgtctccgtgtcgcgacgtcctcgtagtactttacgtagtacgttacgttagtgactagtacggtacgtcggtccgaccgacgccgtaccggaggggtaacggtcgtggacggttacggttcggttaccgaacgtaacgttaaagttaaacggtacggtaaagggtaaacgtaacgtaaacctaaacgttaaaccgttaacgacgtaacgtacgttacggtaagggtaccgggtaaccggtaccgttaacctacccggtaaacccctaccgtaaccggaaacggtaaccggaaccgggaaccgtaaccgaacggttaacctacggtaaccttaccgttccgtaccgtaacgtaaaccgtaaagttacccggaaacggttaaccgaccgttaagggaaccgtaagggtaacccggaggtaaccggtacgtccgttagtacgttttaacgtcggtaaggtcggacggtaaacggtacggtaaccgggttacggggaacggttaccgttaacggtactacccggtaggttacccgg

SEQ ID NO: 44665 - DNA, 766 bp, Homo sapiens
  misc_feature: GYAE6OF02IOSHZ.7.85.H08.1.454.CMB.1.raw
tcagcgtgtctctacacgaccggtgctcgatttagtatcactcagtcgcggggctctcagagaggtgccttagacctggattccaaggcatttccacttggtgatcagcactgaacacagaggactcaccatggagttgggctgtgcgtggttttccttgttgcttattttagaaggtgtaccaatgtgaggtgcagctggtggagtcgtgggggagtcgttggttcacggtccggttcggggggtcccctaggacgtacccttcgtccgtacggtcgtccgacgtcccgttcgtacggttacttttacccgttctaacgttacttagtggtacctagtacggtaaccgtccggggtacccggaccgaccggtccgtaaccggaagggggtaacgggtcgtggtaccgtagggttcggttacaacgtactaagttaactacgtaggtaaacgtacggtaacctaaacgttaacgttacaacgtaacgtaccttacggtacggtaagggaaccgggtaccgttaacgttacccaaacccgtacccgttccgaaaggaaccgaccggaaccgaacccgtaaagtaccctactaccgttacggtccttacgtacgtaactaaacgtacggaacctacggtacgtacgaacggtacgtaaccggaacgggacccgtacgggtaccttaggttacgttattacggtggccgaacggtacgacggtaaggttcccggggtaagtcggtaacgtaccgacgttagtaacccgg

SEQ ID NO: 44666 - DNA, 856 bp, Homo sapiens
  misc_feature: GYAE6OF02HFZW4.7.85.H08.1.454.CMB.1.raw
  modified_base (162)..(162): a, c, t, g, unknown or other
  misc_feature (162)..(162): n is a, c, g, or t
  modified_base (189)..(189): a, c, t, g, unknown or other
  misc_feature (189)..(189): n is a, c, g, or t
  modified_base (771)..(771): a, c, t, g, unknown or other
  misc_feature (771)..(771): n is a, c, g, or t
tcagcgtgtctctacacgaccggtgctcgatttagtatcactcagtcgcgggggctctcagagaggtgccttagcccgtggattccgaaggcatttccacttggtgatcagcactgaacacagaggactcaccatggagttgggctgtgctggtttctgttnctatttagagtgtacagtgtgacggtncagtcgtggtggagtcgtggggacgtcgtttcggttcgaggtcccggtagggggggttacccctaggtaacgtaccgttccgttacccgttaggttcggaccgtaacggtccccgttaccggttacggggttaaccttttttaaccccggtttaccggtaacggttttaaccggtttaacgttaccggggtacccttaaggttaaccggtaaacccggtttccgggggttaccccggtacccggttaacgggtccgtaccccgggtaaagggggtaacggggtcgttacggggacgttagggtttaaccgggtttaccaaccgggtaaccttaagtttaaacgtaaccggtacggggtaaacgttacgggaaacctaacgttaaaaccgtttaccaacgttaacgacttacgtacggtaacgggacggtaccgaacgtttaccgaaccctaacctcgaacgggaacgtaccggaaccggtaacaaacgaccttaacgtacgtaccgtccgttaacgacgacctaaagaccgaccgtaacgccgttagaaccggtaagttccggaacgccgtaacgggttacngtttacgtaacgttcccgtaggtaccggtaagaccggtaggtaccggtacggggtacggactttacggacaaccgttgtaaccgg

SEQ ID NO: 44667 - DNA, 728 bp, Homo sapiens
  misc_feature: GYAE6OF02GWVFD.7.85.H08.1.454.CMB.1.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (660)..(660): a, c, t, g, unknown or other
  misc_feature (660)..(660): n is a, c, g, or t
tcagcgtgtctctacacgaccggtgctcgatttagtatcactcagtcgcgggggctctcagagaggtgccttagccctggattccaaaggcatttccacttggtgatcagcactgaacacagagactcaccatggagttgggctgtgcgttggttttccttgttgcttatttagaaggtntcaatgtgaggtgcngcgtggtggagtcgtgggggnggtgttggttcngccggtcggggggtccctgacgactcgtctgtgcacgcctctggtactttaccttctacgttacttagtggctagtcggtaacgtcgggtcccgaccgaccggtaccgtacggaacgggggtaacgggtcgtcggtacgtaaggttcgggtttaccaacgtaacttaatttaaacgtacgtacgggaaggttacggtaaccctaaacttaaaccttaacgtacaaccgtactacgtgggtacggtaagggtaccctaacgttcccgtaacccacccttacgaacgtacggaaccgaaccgtaaccgaaacgtaacctccctaacggttccgtaccttcgtaacgtactaaacgtaacgaacccgtaacgtccgtaaggaacgtacgggtaccgaacggggtacctaccgggtagtacgttagttaacgtttntacgggtcgaacggtacgtacgggtaggtaaccggggtaggtaaccgtagtaccggactgttaaccgg

SEQ ID NO: 44668 - DNA, 751 bp, Homo sapiens
  misc_feature: GYAE6OF02H5ALC.7.85.H08.1.454.CMB.1.raw
  modified_base (411)..(411): a, c, t, g, unknown or other
  misc_feature (411)..(411): n is a, c, g, or t
  modified_base (658)..(658): a, c, t, g, unknown or other
  misc_feature (658)..(658): n is a, c, g, or t
tcagcgtgtctctacacgaccggtgctcgatttagtatcactcagtcgcgggggctctcagagaggtgccttagccctggattccaaaggcatttccacttggtgatcagcactgaacacagagactcaccatggagttgggctgtgcgttgggttttccttgttgtcttatttttagaaggtgtaccaaatggtgaggtgcagcgtggtggagtcggtgggggtaggtcgtttggttcgacggtccggtcggggggtcccctggagtaccgttccgtccttaggttgaccgtacgtcccgttcgttaggtacctttttaacccgttcgtaacgttaacgtttacgtcggactaagttaacgaaccggttcgggtcccgaccgaggcccgtacgggaaggggtaaccgggngtacgacgtacgggtttcgggttacaacgtacgtaatttaacgtacgtaggaaacgtacggaacttaagtaacttacaacgagtacctagtggacgaacgggtacctaattccgtaacccacgtaccgaggtacgaccgaacgaacaaacgtaactcgtaccttcgtcgtacccgtagaactaaaagtcgtaaacaccggtaccgtacgggaacgaacgggttaccggaaaggaaccgtacggggtnttaacggttcgttaacgtttacggcggtacggtaccgaaaggtacccggaggtaaccggggtaggaccgtttagacccgtacgtagttaccgg

SEQ ID NO: 44669 - DNA, 795 bp, Homo sapiens
  misc_feature: GYAE6OF02HLLJ6.7.85.H08.1.454.CMB.1.raw
  modified_base (603)..(603): a, c, t, g, unknown or other
  misc_feature (603)..(603): n is a, c, g, or t
  modified_base (733)..(733): a, c, t, g, unknown or other
  misc_feature (733)..(733): n is a, c, g, or t
tcagcgtgtctctacacgaccggtgctcgatttagtatcactcagtcgcgggggctctcagagaggtgccttagccctggattccaaggcatttccacttggtgatcagcactagaacacagaggactcaccatggagttggggctgtgcgttgggttttccttgttgcttagtttagaggtgtcatgtgagtgcagtcgtgggtaggagtcggtagggggaggtcgtttggttactacggtccggtcgggggtaccctggacgtacctcgtccgtgtcgcgtacgtccttacgtacggttacttttaccgttcacgtttaacgtttacgtcggtactagttacggtaaccggttcgggtacccgtcggtaccggtccgtaccgggaaggggtacgggctaggtacgtaacgggtttcggttaccagttaacttaattaacgtaccggtaggtaaacgtacgtaaaccttaacgttaaacgttaaccaacgtaacgttacctacgggttaacggtaacggggaacccggtaccgtttaacctaccctaaccccgtaaccgttaacgaacgggaccggtaacccgtaacgaacccgggttaaanaacccgtttccggaaacctttccggttaacgacccttagtaaaaccgtaagtacgaacgtaacgtcggttaacgaagggtaccgtaggaaacctaacgcggttaactttaggttagttacgtttaaccgngggttcggaacgtaggaccggtaggacgggtaacgttcgtaagtacgaccgttaggtaccgg

SEQ ID NO: 44670 - DNA, 747 bp, Homo sapiens
  misc_feature: GYAE6OF02H5NN5.7.85.H08.1.454.CMB.1.raw
  modified_base (198)..(198): a, c, t, g, unknown or other
  misc_feature (198)..(198): n is a, c, g, or t
tcagcgtgtctctacacgaccggtgctcgatttagtatcactcagtcgcgggggctctcagagaggtgccttagacctggattccaaaggcatttccacttggtgatcagcactgaacacagagactcaccatggagttggggctgtgcttgggttttccttgttgcttattttagaaggtgtcaatgtgagtgcagngtggtggagtcgtgggggagtcgttggttcgaggccggtggggggtcccctggagtacctcgtccgtgtcgcgacgtccgttacgttcggtactttttacctacgtacgtttaacgttagtcggactagtacgtaaccgtcggggtcccgccgaggtcccgttacgggaacgggggtaacggggtccgtaggacggttagggtttcgggttacacgtaactaatttaaacgtaacggtaggtaaaggaaccggtaaacctaattaaccgttaaccaacgtacgtaccttcgtaggtacgggaacgggtaccttacgtacccaacctacccctagaaacggacgaaccgtaccgaacccgaacggtaactaccgtacttcgttactacgttacgaactaaacgttacgaacctacggaccgtaggaacggcgggtaaaccgacggaaccgttcgggtacttagttacgtttacgttacggtgggtccgaaggtagggaacgttacgggtaccggggtagtaaccgttaggaccggacctaggttaccggg

SEQ ID NO: 44671 - DNA, 697 bp, Homo sapiens
  misc_feature: GYAE6OF02JVYAE.7.85.H08.1.454.CMB.1.raw
  modified_base (165)..(165): a, c, t, g, unknown or other
  misc_feature (165)..(165): n is a, c, g, or t
  modified_base (526)..(526): a, c, t, g, unknown or other
  misc_feature (526)..(526): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttcctgttgntatttagaggtgtctaatgtgaggtgcagcgtggtggagtcgtgggggagcttggttcagtccgtgggggtccctgacgtactctcctgtcgcacgtcctgtggtactttacctctagttacttagtggcatcgaacgtcgggtccgcgagccgtacggaggggaacgggtctgtcgtacggttcgggtttaccaacgtactagttaactacggtaggaaggtacggtaacctaacttaacgtaacaacgtagtaccgttcgtacgtacgggtaacggtccgtaccttaccgaaccctaccgtaccgaaggtaacgaccgaaccgacgtaaacgaccgtactacgttacgttactcgtaanaccgtaaattaccggaactacgtacccgttagaaggtacggtaccgaacgggtaccgaacggttcgtagttacgtaccgtttaggtccgggtaacgaccgggtaaaggtaccggttacggggtccggggaaagggtaccgtttaaccgtacggtaacgtacggttaccggg

SEQ ID NO: 44672 - DNA, 702 bp, Homo sapiens
  misc_feature: GYAE6OF02FIFHW.7.85.H08.1.454.CMB.1.raw
  modified_base (543)..(543): a, c, t, g, unknown or other
  misc_feature (543)..(543): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgctggtttcctgtgctatttagaggtgtccaatgtgaggtgcagctggtggagtcgtgggggagtcttggttcaggtccgtggggggtccctgacgactcctcctgtgcgagcctcgtggtactttaccgttcgagttacttagtcggactagtcggaacgttcggggtccgccgtaggtcctaccggagggggaacgggtcgtcggcgtaagggttacgggtttacaaccgtacgttaagtttaacgtaacgtaggggtaaacgttaaccgggtaaccctaaagttaaaccttacgaacgaacgtacttcgtaggtacggaacgggccgtatttacccgaaccgtacctcgaaacggacgaaccggacgaccaaaagcctactacttcggttaccngttacgaacctaaagtcgaaactcgtaccgtagaacggtacgtaccggaaacggtaccgagggttccgttaggttacgtaacgttcgttcggagtaaccgggtagaacggttacggacggggtaacggggtactagtaccgggtaccttaggtaccggg

SEQ ID NO: 44673 - DNA, 856 bp, Homo sapiens
  misc_feature: GYAE6OF02ITK1O.7.85.H08.1.454.CMB.1.raw
  modified_base (569)..(569): a, c, t, g, unknown or other
  misc_feature (569)..(569): n is a, c, g, or t
  modified_base (685)..(685): a, c, t, g, unknown or other
  misc_feature (685)..(685): n is a, c, g, or t
tcagcgtgtctctacacgaccggtgctcgatttagtatcactcagtcgcgggggctctcagagaggtgccttagccctggattccaaggcactttccacttggtgatcagcactgaacacagaggactcaccatggagttgggctgtagcgttggtttcctgttcgtctatttagaagtcgtcaatgtgagtgcgagcgtggtggacgtcggtgggggtagtcgttcggttcgacggccggttggggggtaccctaggacggtaccttcgtccgtggtcgtactccggtccttcgtacggtaacttttacccttacgaacgtttacttaacggtcggacgtaacgttcggtaaaccgttcggggtccccgtaccggtaacgggccgttacccggaagggggaacgggtctcggaccgtaggttcggttacgaactaactaagttaaacgtacgtaaggtaccggttaaagaaccctaaagttaaacctaacgtaaccgtaacgtaaccgttacgttagggtaacggtaacggggtaccctaactttaacccgaaccccgtttaaacccnccgggtaaagaaccgggtaaaacccgtaacccgtaaacgtaaaaccggtaaacccttaccggtacgttttcccggaaccgttactacgggaaaactttaaaagggcgtaaaacccncgtaaccgtaggaaggaacccggttcgaaaaaccgggaccggtaaccgttacggttacgttaaacgggtttaccgttaaccgggttctaccggggtaaacggtaaaccggaggtttacccgggaaccccggggtaaggggtaaccctagggtaactacccggtacgttcgg

SEQ ID NO: 44674 - DNA, 763 bp, Homo sapiens
  misc_feature: GYAE6OF02JH8RR.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttgggctgtgcttgggttttccttgttgtctagttttagaaggtgtccaatgtgaggtgcagctggtggagtcgtggggaggcgttggttcgagccggtcggggggtcctgacgtacctcgtccgtgtcgcacgtccttcgtcggttacttttaccttacgtacgttacttagttcggtacaagttcgtaaccggtcgggtcccgaccgtaacggtccttaccggaagggggtaaccgggtcgtaggtccggtaggttacgggttttacaaccgtaacgtaagtttaaactacggtaacgggtaaaggttaacggaaccttaaacgtttaaaccgtttaacgaaaccgtaacgtaccttccgtacgggttaggaaccgggtacccgtaattaacccgtaacccgtaaccgtacccgaacggtaacgaaaccggaccgtaaaccgaaaccgtaactccgtaaccttcgttaccttaccgacgtaaactaaacgtacgaacgtaccgaccgtaggtaacgaacggtacggtaacggaccgtacgtccgtacggttacgttattacggtggtacgtaggacgtaacgaccggttacgggacgggtacacggtacgtacgtaccgtacgg

SEQ ID NO: 44675 - DNA, 963 bp, Homo sapiens
  misc_feature: GYAE6OF02GJQJQ.7.85.H08.1.454.CMB.1.raw
  modified_base (228)..(228): a, c, t, g, unknown or other
  misc_feature (228)..(228): n is a, c, g, or t
  modified_base (343)..(343): a, c, t, g, unknown or other
  misc_feature (343)..(343): n is a, c, g, or t
  modified_base (858)..(858): a, c, t, g, unknown or other
  misc_feature (858)..(858): n is a, c, g, or t
  modified_base (890)..(890): a, c, t, g, unknown or other
  misc_feature (890)..(890): n is a, c, g, or t
tcagcgtgtctctacacgaccggtgctcgatttagtatcactcagtcgcgggggcgtctcagagaggtgccttagccctggattccaaggcatttcctacttggtgatcagcactgaacacagaggactacacctagtggagttcggggctggtcgtcggttcgggtttttccgttgtttggtctttaagtttttaggtaaagggttcgttaccgtaagttggttagngggtagcaggtcgtgggtggtaggtcggtggggggtacggtcggtttggttccgtaggccggttcggggggggttaccctgggacgttaccgtccgttacccgtgggttcggccncggaccccgttaggttcgggttaactttttaaccccgtttccgtaaacgtttaaccgttttacgttcgggtaacccttaaggttaagggaaaccgttttccgggggtaccccggaccccggtaaacgggtcccggttaccccgggtaaaagggggggaaccggggtttactcccgggtagggtttaaccggggtttacggggttttaacccaaccgttaaacgttaaaacggtttttaaaagaaccctttaagggggggtaaaccgtttaaaccgggaaaaccctttaaacgttaaaaacccgttttaacgtaaaaccgaaccgggtttttaccgaaccggttttacggggtaaaaggtaaccggggtaccccgttaacgtttaaccccgaacccgttaccccgttaacgtaaacccggaaccgaaccggtaaacccgtaacccgaaacgtaacccgttaacacccgttgtaacccttcgaacgtaacaacgtaacgtaacacgtaaccgtacgnggtaacgagaaacggcgtacgagtgttagttntaccggttggacacggtacgaaggttacccggaccgggtaagggtacccgttaggaccgtacgtagtaaccgg

SEQ ID NO: 44676 - DNA, 754 bp, Homo sapiens
  misc_feature: GYAE6OF02FW1LB.7.85.H08.1.454.CMB.1.raw
tcagcgtgtctctacacgaccggtgctcgatttagtatcactcagtcggcgggggctctcagagaggtgccttagacctggattccaaggcatttccacttggtgatcagcactgaacacagaggactcaccatggagttgggctgtgcgttggttttcctgttgcttattttagaggtgtccaatgtgagtgcagctggtggagtcgtgggggacgtcgttgggttcacggtccggttcggggggtaccctggacgtaccgttcctccgttgtcgacacggtcccttacgtggttaccttttacccgttagtacgttaccgttagtcggtacacgttagtaaccggttcggggtccccgacgtacgggtcccgtacccggtaagggggtaaacgggtcgtacggtacgttacgggttcgggtttaaccaacccgtaagttaaacgtttaacgtaaccggtagggtaaacggttaccggaaacctaacgttaaaccttaacgaacgtacgtaaccgttcggtaggtacgggaaccgggtaccttataacccaccgtaacctccgaacggtagaaacccggtcaaccgtaaacaccgttacagttccgtactcggtacaacgtagaccgaagtcgtaccgtaggagttcggaacggtaacggccgtaagttcgtagttacgtttaactcggtaacggcggaaacgtggtaaacggtccgttaccgggggagttacgacttacggacttagtccgg

SEQ ID NO: 44677 - DNA, 911 bp, Homo sapiens
  misc_feature: GYAE6OF02IR1M2.7.85.H08.1.454.CMB.1.raw
  modified_base (183)..(183): a, c, t, g, unknown or other
  misc_feature (183)..(183): n is a, c, g, or t
tcagcgtgtctctacacgaccggtgctcgatttagtatcactcagtcggcgggggctctcagagaggtgccttagccctggattccaaggcatttccacttggtgatcagcactgaacacagaggactcaccatggaggttgggctgtgcgtggttttccttgttgacttattttagaaggtntaccaatgtgaggtgcagctggtggagtcggtggggagtcgttggttcgacggtccggttcggggggtcccttaggaactaccgttaccgtaccgttcggtagtcccgtaacgtaccccgtttcggttacgggttaacctttttaaccccgtttacggtaaaccggttaacctttttaacggttacgggtaaccgtaacgttaacggttaaaacccgggtttcgggggttaaccccccggtaaccggtaacccgggttcccgttaacccggggtaacgggggggtaacggggtaccggttaacgggtcccggttaaggggtttaccggtttaccggaaaccttaaccgttaaagttaaaccgttaacggtaaacgggtaaaaggtaccgggtaaaaccttaaagtttaaaccttaaccgaaacgtaacgtaaccgttgtaaccggttacgggaaacgggttaccgtaaccggtttacccaaaccctacccgtaaccgaacggtaacgaaccggaaccgaaccggtaaaccaaccgttacgaaccgttaccgtcgtaccgtaacgtaacgtaacgtacgtaaacgacgttacccgtaaggccgtaacggttagaaaccggtacccgaaggttacgtacggttattaccgtttacgtaggtttacggacggtaacgtacggtaacggtacgggtaacgggttaacgtacggtaccgtaacgtgtaaccgg

SEQ ID NO: 44678 - DNA, 721 bp, Homo sapiens
  misc_feature: GYAE6OF02I0RUY.7.85.H08.1.454.CMB.1.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagcgtgtctctacacgaccggtgctcgatttagtatcactcagtcgcggggctctcagagaggtgccttagccctggattccaaggcatttccacttggtgatcagcactgaacacagaggactcaccatggagttggggctgtgcgttgggttttccttgttgtcttatttagaaggtgtccaagtgtgaggtgcgtagctggtggagtcgtggggagtcgttggttcaggtccgtggggggtccctgacgactctcctgtgcgacncctntaggtacttttacctgtagtaccttagtcggactagtacgacgtcgggtcccgtccgtaacggtcctaccggaaggggaacgggtcgtaggccgtaaggtttcgggtttacacgtaacgttaacttaacttacggtaaggtaagtaaccggtaacctaacgttaaccgttaaacgaacgtaacgtaccgtcgttacggtacgaaccggggtccgtaacgttacccgtaactacccccccttagaacggacgaaccgtaaccgaccgaaacgtaacgtacctacgttacgtcctctacgaacaagtacgaacgtacgtaccgagtacgtacgtacgtaacggacgtacggtctacggttagttaaccgttacggtcgtacggccggtaaggtacggtacggtaccggggtaacgggaccggttacgttacggaccgttaggtacccgg

SEQ ID NO: 44679 - DNA, 709 bp, Homo sapiens
  misc_feature: GYAE6OF02IDPD6.7.85.H08.1.454.CMB.1.raw
  modified_base (192)..(192): a, c, t, g, unknown or other
  misc_feature (192)..(192): n is a, c, g, or t
  modified_base (628)..(628): a, c, t, g, unknown or other
  misc_feature (628)..(628): n is a, c, g, or t
  modified_base (653)..(653): a, c, t, g, unknown or other
  misc_feature (653)..(653): n is a, c, g, or t
  modified_base (660)..(660): a, c, t, g, unknown or other
  misc_feature (660)..(660): n is a, c, g, or t
  modified_base (703)..(703): a, c, t, g, unknown or other
  misc_feature (703)..(703): n is a, c, g, or t
tcagcgtgtctctacacgaccggtgctcgatttagtatcactcagtcggcgggggctctcagagaggtcgccttagccctggattccaaggcatttccacttggtgatcagcactgaacacagagactcaccatggagttgggctgtgcgttggttttccttgtgctattttagagtgtcaatgtgaggtgnagcgtgggtggagtcgtgggggagcgtttggttacgagtccggtcgggggtccctggacgactctccgtgtcgcacgtcgtacgttggtaccttttaccttacgacggttaacttagtcggactagttacgtaccgttcggggtacccgaccggtacggtccgtaccggaacggggaacgggcgttcggacggtacggtttgggtttaacactaactaattaaacgtacggtaggaaacggtacggaacctaaattaaaccgttaaccactaacgaccgttcgtagtacgggaccgggtaccgtacttacccgaacccctaacccgtacgaacggacgtaaccggaaccgaacccgaaacgtaaacctcgtacgttacgtacttacgttacgaaactaaagttccaaacgtacgcgtagaggagtaccgagaccgnggttacgtgttacgtaatttacggngtaacgnggacgacgtaccggtacggagggtaacgttacgacgtaccgtntaccgg

SEQ ID NO: 44680 - DNA, 942 bp, Homo sapiens
  misc_feature: GYAE6OF02GGJ56.7.85.H08.1.454.CMB.1.raw
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgcttattttagaaggtgtccaatgtgaggtgcagcgtgggtaggagtcggtgggggagtctttggttcaggtccgttcggggggtccctgacgtacttctccgtgtgcacggtcctcgtggtactttaccttctaagttaccttagtcggctaataggtaacgttcggggtacccgccgacgggtaccgttccggaaggggtaacggggtcctaggacccgtaggttacgggtttaccaactaacgtaatttaagtaacggtaacgggtaaggtaccgtaaacccgttaaagttaaacccgtttaaaccgacctaaacgttaccgttacgtttaaccgggtaacggggtaaaaccggggtaccccggtttaagtttaaacccccgaaccccgttaaccccccggttaaacccgtaagggtaaaaccccgggtaaacccgggtaaacccccggaaaaccccggtaaaaaccggtaaaccccttaccgggttaaacccgtttccggtttacccgttaaccgtaacgggtaaacctaaaaaccggtcggtaaaaacccgtcgggttaaccccgtttaagggaaccgggttaacggttacccgggaaaccggtaaacccggtaacccgggtacctttagggttttaaccgtttaaccggtttaacccggtgggggtttaaacccgaccgggtaaaggttacccgggttaccggggtaacccgggggttaggggggtaaaccccggtaactttaccgggtaacccgttaggttttaacccggg

SEQ ID NO: 44681 - DNA, 780 bp, Homo sapiens
  misc_feature: GYAE6OF02HJBS4.7.85.H08.1.454.CMB.1.raw
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (185)..(185): a, c, t, g, unknown or other
  misc_feature (185)..(185): n is a, c, g, or t
  modified_base (274)..(274): a, c, t, g, unknown or other
  misc_feature (274)..(274): n is a, c, g, or t
tcagcgtgtctctacacgaccggtgctcgatttagtatcactcagtcggcggggctctcagagaggtgccttagacctggattccaaggcatttccacttggtgatcagcactgaacacagagactcacatggagtgggctgtgctggtttcttgtnactattttagaggtntcaatgtgaggtncagctgggtggacgttgtcgggggagtcttggttcgacgccgtcggggggtcctgagtctcgtctgagcagcctgtgttacttaccttnacgttctagtggactagtagacgtcgggcccgacgacggtccgtaccggaaggggacgggtctgacggtagttcgggttacacgtacgtaagtttaaactacggtaggtaacggtaacgtaccttaacgtaaaccgttaacaaacgtacgtaaccgttacttacggggtaacggaaccgggtaccgtttacgttcccaaacccgtacccgttacggaaccgtaaaccggaccgtaaacccgtaccgtaaaacggtaccccgttacgtaaaccgttccgtttacggttaaccgtacgtaaaccgttaaaacggttacgaaaacccggttgttaaccccggtaaggttaacgggtaacccggttacgggaaaacccggggtactaaacggggtcctttacggtaagggttttacttaccgggtttgacccgggttaggaaccgttaagggacccgggtacccggggttaaggggtacgtaacgtcggtaaccctaggtttaacccggg

SEQ ID NO: 44682 - DNA, 759 bp, Homo sapiens
  misc_feature: GYAE6OF02F3AJC.7.85.H08.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
  modified_base (698)..(698): a, c, t, g, unknown or other
  misc_feature (698)..(698): n is a, c, g, or t
  modified_base (750)..(750): a, c, t, g, unknown or other
  misc_feature (750)..(750): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttggttttccttgttgcttatttagaggtntacaatgtgaggtgcagcgtggtggagtcggtgggggagtcgttggtcngccggtcggggtcctgacgctctccgtgtcgcagcctgtgtactttacctctagttacttagtggctatgacgtcgggtccgtcgacggcgtaccggaggggtacggggctggacgtagggttcggttaccaacgtaactaacgtttaacgtacgtaagggtaacgtaaccggaacctaaacgttaaaccttaacaccgtagtacttcggtacggttacgggaacgggtacctacgtttaccccgaaccccttacccgtaccgggtaaacggaaccggacccggtaaaccccgaacccgtaaaaaccgttcccctttaccgtaacccgtttccgggttaaccttaccgggtaacgtaaacccgtaaaaatccgtaaaacctacccgggcgttagggacggtaaccgtaccgggtaaccggaaccggtacgttaccgttaggttaaccgttacggttagtggggtaaccgngggtaaacgtcggtaaccgggtcgggggaagttaccgtaagtcccggtacgngttacccgg

SEQ ID NO: 44683 - DNA, 774 bp, Homo sapiens
  misc_feature: GYAE6OF02GFI0K.7.85.H08.1.454.CMB.1.raw
  modified_base (587)..(587): a, c, t, g, unknown or other
  misc_feature (587)..(587): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgctatttagaggtgtccaatgtgagtgcagctgggtggagtcgtgggggagtcgttggtcgaggtccggtcgggggtccctggacgtaccttccgttccgtggtacggtccgacggtcccgttacgtcggttaccttttaaccctttcgtaacgtttaacttacgttcggtactaagtacggtaaccggttccggggtacccgaccgacggtccgtacccgggtaagggggaacggggtcgtcggtacgttaacgggttcgggttaccactaacgtaacgtttaaacgttaaccggtaggggtaaacgttacggtaacctaaacgttaaccttacgaacgtaacgtactacgtaggtacggaacgggtctaacgttacacccgtaccaccgaagacgtaccgaaccgaccaaacgacctacnccgtactccgtacgtacgaactaacgaacgtaacgaaccggttccgtaacggaacggttacgacggtaaccggaccgtacgtacgttaggttacgttacgttacggtaggtcggtaaccggtacgtaacgggttaccgggaccgggttacggggtaaccttaggtcccggtaacgttgtaacccggg

SEQ ID NO: 44684 - DNA, 817 bp, Homo sapiens
  misc_feature: GYAE6OF02FWFZ5.7.85.H08.1.454.CMB.1.raw
  modified_base (267)..(267): a, c, t, g, unknown or other
  misc_feature (267)..(267): n is a, c, g, or t
tcagcgtgtctctacacgaccggtgctcgatttagtatcactcagtcgcgggggctctcagagaggtgccttagccctggattccaaggcatttccacttggtgatcagcactgaacacagaggactcaccatggagttggggctgtgcttgggttttccttgttgcttattttagaaggtgtccaatgtgaggtgcagcgtggtggagtcgtgggggagtcgttggtcaggtccgtggggggtccctggacgacctctcctgtgcngcctgtggtactttaccttcgagttacttatggctagtggaacgttcggggtccaccgtacggtacctccggaagggggtaacgggtcgtcggacggttaagggttcgggttttacccaactaacgttaactttaacgtaacggtaagggtaaacggttacgggaaaaccctaacgtttaaaacccgtttaacgaaaccggtaacgtaccgttacgtacgggttaacggggtaaacggggtcccgtaactttacccgaaacccccgtacccgtaaccgacgggtaaacggaacccggtaccccggaaaccgtaaaaccggaaccttaccgaaccgttacgttccgttaccgtacgaaacttaaaggtacccgaaaccgtacggtacccgtagggtaaaccgtacgggttaaccgaacggaacccggtaacgggtccttaaccgggttagttaaccgttccggtttaagggtacccggaacgttaacgggagttacccggggtacggggacgggttaaccctaacgtacggtaccctaggttaaccccggg

SEQ ID NO: 44685 - DNA, 880 bp, Homo sapiens
  misc_feature: GYAE6OF02G46U8.7.85.H08.1.454.CMB.1.raw
  modified_base (174)..(174): a, c, t, g, unknown or other
  misc_feature (174)..(174): n is a, c, g, or t
tcagcgtgtctctacacgaccggtgctcgatttagtatcactcagtcggcgggggctctcagagaggtgccttagccctggattccaaggcatttccacttggtgatcagcactgaacacgagacgactccacagtggtaggttgggctgtgtcgtttcgggttttccttgttntcttagtttagaaggtgtactaagtcgtggtagtcgctagtcgtgggtacggagtcgggtgggggagttcgtttggttcgacggtccgggttcgggggtccctaggtacgtaccgttccgtaccgttggtacgtacccgtaccgtcccgttacgttaacggttttaacctttttaaccccgttaccggtaacgttttaaaccgttggttacggtacccgtaaaggttacccgggtaacccgggttcccggggtacccccggaaccggtacgggttaaccccggtaccgggggaaagggggtaaccggggtcctaaggtacggttaacggggtttaccggttaccgaaaccgttaacgttaaacgttaacgtagggtaaacgggtaaacgtaaccggtaaacttaaacctaacgtaactaacgtacgttaccgtagtaacggtacggaaccggtcttacctaccaccctaccgaacgacggtaaccgaccgaccggaataaacccgtacgtaccttacgtctacctacgtactaacacgtaaacgaccgtagtacgagttaaccggaggtaaccgtaacggaccggacgttacggtttagtaacttttaccggtacgttggtaccggtaaaggtagggtaaccggggttaggttaaccggggggtaacgtgggtttaaacccggacgttacggtttaccgttacggg

SEQ ID NO: 44686 - DNA, 714 bp, Homo sapiens
  misc_feature: GYAE6OF02IVIK6.7.85.H08.1.454.CMB.1.raw
  modified_base (233)..(233): a, c, t, g, unknown or other
  misc_feature (233)..(233): n is a, c, g, or t
  modified_base (605)..(605): a, c, t, g, unknown or other
  misc_feature (605)..(605): n is a, c, g, or t
  modified_base (612)..(612): a, c, t, g, unknown or other
  misc_feature (612)..(612): n is a, c, g, or t
tcagcgtgtctctacacgaccggtgctcgatttagtatcactcagtcggcgggggctctcagagaggtgccttagccctggattccaaggcatttccacttggtgagtcagcactgaacacagaggactcacatggagttgggctgtgtcgtgggttttccttgttgcttatttttagaaggtgtccaatgtgaggtgcagcgtggtgacgtgtgggggagcgttggttacgngtccggtaggggggtccctggacgtacttcgtcttggcgcacggctcgttaggttaccttttaccttcgtaacgttacttagttacggatacgtagtaacggtcgggtaccgccggacggtcctccgggaaggggtacgggtcgtacgccggtaggttcggttacacttaatagttaaactcgtaggaacgtaggaccctaagttaaaccttgaaacgagtacttactggtacggaaccgggtcgtaaaccgttccaacccgttaacccgacgaaccggccgttaacgaccgtaacgaaaccgtacccgtctaacggtttctacggtacgttacgaactaaaggtaccacaccggtgtaacgcgggttaacncgggganaaaccgttcgtcgtagtttacagttttcgaagggtcgaacggtaaaggccgttaaaccgggcggggttacggtaagtccggtaacgacggttaccttacggg

SEQ ID NO: 44687 - DNA, 722 bp, Homo sapiens
  misc_feature: GYAE6OF02HOBST.7.85.H08.1.454.CMB.1.raw
  modified_base (207)..(207): a, c, t, g, unknown or other
  misc_feature (207)..(207): n is a, c, g, or t
tcagcgtgtctctacacgaccggtgctcgatttagtatcactcagtcgcgggggctctcagagaggtgccttagccctggattcccaaggcattttccacgttggtgatcagcactgaacacagaggactcaccatggagttgggctgtgtcttgggtttttccttgttgtcttattttagaaggtgtacctaatgtagaggtgacngtcgtggtggagtcgtggggagtcgttggtcacgtccggtcggggttcctaggacgaccttcctcctggtcgcgtacgtccgttcgtacggttaccttttaccttacgtaacgtttacgtttaagtcggtactaacgttacggtaaccggttcgggtccccgtacggaccggtccgttaaccgggagggggtacgggcttcggtacggtaacgggtttccgggttaacaacgttaaccttaagttaacggtacgtaacggggaaacggttaccgtaaaccctaagttaaccgtaacacgtacgtacttcgtaggtacggacgtcctaactccctaccgtaccgtcgaagaccgacgtaaccgacgaactacctcgtaactcgtacctcgatacaagtacgactagacgtacgaagtacgtacgcgtaacgcgtacgtgtttaccgtttaatacggtacgtggaacgttcggacggtaacggttcgggaacggtcttaggtacgaccgtgttacgg

SEQ ID NO: 44688 - DNA, 706 bp, Homo sapiens
  misc_feature: GYAE6OF02IT3VJ.7.85.H08.1.454.CMB.1.raw
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagcgtgtctctacacgaccggtgctcgatttagtatcactcagtcggcggggctcgtcagagaggtgccttagccctggattccaaggcatttccacttggtgatcagcactgaacacagaggactcaccagtggagttgggctgtgctgggtttccttgttgctatttagaaggtgtccaatgtgagtgcagctggtggagtcgtgggggagcgttggttcacgcgtgggggtccctgagctcgtcctgtcgcacgtcctgtaggtattttacccttctaaggttacttagtcggtccagttacgaacgtcgggtcccacgacggtccgtaccggaagggggtaggggtcctacggtcgaagggtttcgggtttacaactaacgtaaagtttaacacgtagggaaacgttaaccggaacctaattaaaccgttacaactaacggtacttaccgttgacgggaacggccgtaacttcaacccttacgcccgaagaccgacgacctacaacggacctanaccgttntaccgcttagactaaatccgtaacgacgtcccgaggaacgtacggtacgggaacgggtaacccgtacgggtacttagggttacttacccggtttagtacgggttggaaaccgaagggtaacggtaaggttccccggggaaggggttattaaccggacgttaacccgaaggtttcccggg

SEQ ID NO: 44689 - DNA, 118 bp, Homo sapiens
  misc_feature: GYAE6OF01BHRIL.51.41.D08.1.454.CMB.1.raw
  modified_base (118)..(118): a, c, t, g, unknown or other
  misc_feature (118)..(118): n is a, c, g, or t
tcagcgatcgtatacacgaccggtgctcgatttagtcacgcgagaaagggaagggcagcgtcactctgttcccaccctcctctcgtagcactctgagcgggctggcaaggcgcatagn

SEQ ID NO: 44690 - DNA, 156 bp, Homo sapiens
  misc_feature: GYAE6OF01DR7VS.51.41.D08.1.454.CMB.1.raw
  modified_base (131)..(156): a, c, t, g, unknown or other
  misc_feature (131)..(156): n is a, c, g, or t
tcagcgatcgtatacacgaccggtgctcgatttagtcacgcgagaaagggaaaggggctggacccgtgaacgtgtttcctgttcccaccctcctctcgtagcactctgagcgggctggcaaggcgcatagnnnnnnnnnnnnnnnnnnnnnnnnnn

SEQ ID NO: 44691 - DNA, 118 bp, Homo sapiens
  misc_feature: GYAE6OF01BGGIW.51.41.D08.1.454.CMB.1.raw
  modified_base (118)..(118): a, c, t, g, unknown or other
  misc_feature (118)..(118): n is a, c, g, or t
tcagcgatcgtatacacgaccggtgctcgatttagtcacgcgagaaagggaaagggcagcgtcactctgttcccaccctcctctcgtagcactctgagcggctggcaaggcgcatagn

SEQ ID NO: 44692 - DNA, 153 bp, Homo sapiens
  misc_feature: GYAE6OF01A2YSP.51.41.D08.1.454.CMB.1.raw
  modified_base (132)..(153): a, c, t, g, unknown or other
  misc_feature (132)..(153): n is a, c, g, or t
tcagcgatcgtatacacgaccggtgctcgatttagtcacgcgagaaagggaaagggggtcgtggccctgaccgtgtttctgttcccgccctcctctcgtagcactctgacgcgggctggcaaggcgcatagnnnnnnnnnnnnnnnnnnnnnn

SEQ ID NO: 44693 - DNA, 127 bp, Homo sapiens
  misc_feature: GYAE6OF01B24AM.51.41.D08.1.454.CMB.1.raw
  modified_base (127)..(127): a, c, t, g, unknown or other
  misc_feature (127)..(127): n is a, c, g, or t
tcagcgatcgtatacacgaccggtgctcgatttagtcacgcgagaaagggaaaggggctggccctgacgtgtttctgttcccaccctcctctcgtagcactctgagcgggctggcaaggcgcatagn

SEQ ID NO: 44694 - DNA, 118 bp, Homo sapiens; identical to SEQ ID NO: 44691
  misc_feature: GYAE6OF01AGN9G.51.41.D08.1.454.CMB.1.raw
  modified_base (118)..(118): a, c, t, g, unknown or other
  misc_feature (118)..(118): n is a, c, g, or t

SEQ ID NO: 44695 - DNA, 133 bp, Homo sapiens
  misc_feature: GYAE6OF01B5GHM.51.41.D08.1.454.CMB.1.raw
  modified_base (132)..(133): a, c, t, g, unknown or other
  misc_feature (132)..(133): n is a, c, g, or t
tcagcgatcgtatacacgaccggtgctcgatttagtcacgcgagaaagggaaaggggctggcaaggcgcatagctgcctggtcaaggactacttcctcgtagcactctgagcgggctggcaaggcgcatagnn

SEQ ID NO: 44696 - DNA, 124 bp, Homo sapiens
  misc_feature: GYAE6OF01B2L14.51.41.D08.1.454.CMB.1.raw
  modified_base (118)..(124): a, c, t, g, unknown or other
  misc_feature (118)..(124): n is a, c, g, or t
tcagcgatcgtatacacgaccggtgctcgatttagtcacgcgagaaagggaaagggcagcgtcactctgttcccgccctcctctcgtagcactctgagcggctggcaaggcgcatagnnnnnnn

SEQ ID NO: 44697 - DNA, 129 bp, Homo sapiens
  misc_feature: GYAE6OF01C1AF4.51.41.D08.1.454.CMB.1.raw
  modified_base (127)..(129): a, c, t, g, unknown or other
  misc_feature (127)..(129): n is a, c, g, or t
tcagcgatcgtatacacgaccggtgctcgatttagtcacgcgagaaagggaaaggggctggtcctgacgtgtttctgttcccaccctcctctcgtagcactctgagcgggctggcaaggcgcatagnnn

SEQ ID NO: 44698 - DNA, 120 bp, Homo sapiens
  misc_feature: GYAE6OF01A78YN.51.41.D08.1.454.CMB.1.raw
  modified_base (117)..(120): a, c, t, g, unknown or other
  misc_feature (117)..(120): n is a, c, g, or t
tcagcgatcgtatacacgaccggtgctcgatttagtcacgcgagaaagggaagggcagcgtcactctgttcccgccctcctctcgtagcactctgagcggctggcaaggcgcatagnnnn

SEQ ID NO: 44699 - DNA, 122 bp, Homo sapiens
  misc_feature: GYAE6OF01AWTTW.51.41.D08.1.454.CMB.1.raw
  modified_base (119)..(122): a, c, t, g, unknown or other
  misc_feature (119)..(122): n is a, c, g, or t
tcagcgatcgtatacacgaccggtgctcgatttagtcacgcgagaaagggaaagggcagcgtcactctgttcccaccctcctctcgtagcactctgagcgggctggcaaggcgcatagnnnn

SEQ ID NO: 44700 - DNA, 117 bp, Homo sapiens
  misc_feature: GYAE6OF01DDUSX.51.41.D08.1.454.CMB.1.raw
tcagcgatcgtatacacgaccggtgctcgatttagtcacgcgagaaagggaaagggcagcgtcactctgttcccgccctcctctcgtagcactctgagcggctggcaaggcgcatag

SEQ ID NO: 44701 - DNA, 126 bp, Homo sapiens
  misc_feature: GYAE6OF01CESFA.51.41.D08.1.454.CMB.1.raw
tcagcgatcgtatacacgaccggtgctcgatttagtcacgcgagaaagggaaaggggctggccctgacgtgtttctgttcccaccctcctctcgtagcactctgagcgggctggcaaggcgcatag

SEQ ID NO: 44702 - DNA, 132 bp, Homo sapiens
  misc_feature: GYAE6OF01BALD9.51.41.D08.1.454.CMB.1.raw
  modified_base (132)..(132): a, c, t, g, unknown or other
  misc_feature (132)..(132): n is a, c, g, or t
tcagcgatcgtatacacgaccggtgctcgatttagtcacgcgagaaagggaaaggggctggcaaggcgcatagctgcctggtcaaggactacttcctcgtagcactctgagcgggctggcaaggcgcatagn

SEQ ID NO: 44703 - DNA, 118 bp, Homo sapiens
  misc_feature: GYAE6OF01AYD6J.51.41.D08.1.454.CMB.1.raw
  modified_base (117)..(118): a, c, t, g, unknown or other
  misc_feature (117)..(118): n is a, c, g, or t
tcagcgatcgtatacacgaccggtgctcgatttagtcacgcgagaaagggaagggcagcgtcactctgttcccgccctcctctcgtagcactctgagcggctggcaaggcgcatagnn

SEQ ID NO: 44704 - DNA, 139 bp, Homo sapiens
  misc_feature: GYAE6OF01BBYZ6.51.41.D08.1.454.CMB.1.raw
  modified_base (131)..(139): a, c, t, g, unknown or other
  misc_feature (131)..(139): n is a, c, g, or t
tcagcgatcgtatacacgaccggtgctcgatttagtcacgcgagaaagggaaagggctggcaaggcgcatagctgcctggtcaaggactacttcctcgtagcactctgagcgggctggcaaggcgcatagnnnnnnnnn

SEQ ID NO: 44705 - DNA, 164 bp, Homo sapiens
  misc_feature: GYAE6OF01D2AJ4.51.41.D08.1.454.CMB.1.raw
  modified_base (113)..(113): a, c, t, g, unknown or other
  misc_feature (113)..(113): n is a, c, g, or t
  modified_base (129)..(129): a, c, t, g, unknown or other
  misc_feature (129)..(129): n is a, c, g, or t
  modified_base (131)..(132): a, c, t, g, unknown or other
  misc_feature (131)..(132): n is a, c, g, or t
  modified_base (134)..(135): a, c, t, g, unknown or other
  misc_feature (134)..(135): n is a, c, g, or t
  modified_base (138)..(139): a, c, t, g, unknown or other
  misc_feature (138)..(139): n is a, c, g, or t
  modified_base (141)..(143): a, c, t, g, unknown or other
  misc_feature (141)..(143): n is a, c, g, or t
  modified_base (145)..(164): a, c, t, g, unknown or other
  misc_feature (145)..(164): n is a, c, g, or t
tcagcgatcgtatacacgaccggtgctcgatttagtcacgcgagaaagggaaaggggctggcaaggcgcatagctgcctggtcaaggctacttcctgtagcactctgagcggntggcaaggcgcatagnannannagnncnnnannnnnnnnnnnnnnnnnnnn

SEQ ID NO: 44706 - DNA, 125 bp, Homo sapiens
  misc_feature: GYAE6OF02F7XP2.51.41.D08.1.454.CMB.1.raw
  modified_base (125)..(125): a, c, t, g, unknown or other
  misc_feature (125)..(125): n is a, c, g, or t
tcagcgatcgtatacacgaccggtgctcgatttagtcacgcgagaaagggaagggctggccctgacgtgtttctgttcccaccctcctctcgtagcactctgagcgggctggcaaggcgcatagn

SEQ ID NO: 44707 - DNA, 119 bp, Homo sapiens
  misc_feature: GYAE6OF02FR1R7.51.41.D08.1.454.CMB.1.raw
  modified_base (119)..(119): a, c, t, g, unknown or other
  misc_feature (119)..(119): n is a, c, g, or t
tcagcgatcgtatacacgaccggtgctcgatttagtcacgcgagaaagggaaagggcagcgtcactctgttcccgccctcctctcgtagcactctgagcgggctggcaaggcgcatagn

SEQ ID NO: 44708 - DNA, 125 bp, Homo sapiens
  misc_feature: GYAE6OF02GC3UB.51.41.D08.1.454.CMB.1.raw
tcagcgatcgtatacacgaccggtgctcgatttagtcacgcgagaaagggaaagggctggccctgacgtgtttctgttcccaccctcctctcgtagcactctgagcgggctggcaaggcgcatag

SEQ ID NO: 44709 - DNA, 120 bp, Homo sapiens
  misc_feature: GYAE6OF02GEN68.51.41.D08.1.454.CMB.1.raw
  modified_base (119)..(120): a, c, t, g, unknown or other
  misc_feature (119)..(120): n is a, c, g, or t
tcagcgatcgtatacacgaccggtgctcgatttagtcacgcgagaaagggaaagggcagcgtcactctgttcccgccctcctctcgtagcactctgagcgggctggcaaggcgcatagnn

SEQ ID NO: 44710 - DNA, 118 bp, Homo sapiens
  misc_feature: GYAE6OF02GDRFI.51.41.D08.1.454.CMB.1.raw
tcagcgatcgtatacacgaccggtgctcgatttagtcacgcgagaaagggaaagggcagcgtcactctgttcccaccctcctctcgtagcactctgagcgggctggcaaggcgcatag

SEQ ID NO: 44711 - DNA, 119 bp, Homo sapiens; identical to SEQ ID NO: 44707
  misc_feature: GYAE6OF02JDU5I.51.41.D08.1.454.CMB.1.raw
  modified_base (119)..(119): a, c, t, g, unknown or other
  misc_feature (119)..(119): n is a, c, g, or t

SEQ ID NO: 44712 - DNA, 146 bp, Homo sapiens
  misc_feature: GYAE6OF02HD0GZ.51.41.D08.1.454.CMB.1.raw
  modified_base (133)..(146): a, c, t, g, unknown or other
  misc_feature (133)..(146): n is a, c, g, or t
tcagcgatcgtatacacgaccggtgctcgatttagtcacgcgagaaagggaaaggggctgggcaaggcgcatagctgcctggtcaaggactacttcctcgtagcactctgagcgggctggcaaggcgcatagnnnnnnnnnnnnnn

SEQ ID NO: 44713 - DNA, 127 bp, Homo sapiens
  misc_feature: GYAE6OF02GFD1J.51.41.D08.1.454.CMB.1.raw
tcagcgatcgtatacacgaccggtgctcgatttagtcacgcgagaaagggaaagggggctggccctgacgtgtttctgttcccaccctcctctcgtagcactctgagcgggctggcaaggcgcatag

SEQ ID NO: 44714 - DNA, 132 bp, Homo sapiens
  misc_feature: GYAE6OF02IRWU3.51.41.D08.1.454.CMB.1.raw
  modified_base (132)..(132): a, c, t, g, unknown or other
  misc_feature (132)..(132): n is a, c, g, or t
tcagcgatcgtatacacgaccggtgctcgatttagtcacgcgagaaagggaagggtgatcttgctgacgaaatttcttcatcttcccgccatctgatcgtagcactctgagcgggctggcaaggcgcatagn

SEQ ID NO: 44715 - DNA, 132 bp, Homo sapiens
  misc_feature: GYAE6OF02FWFTD.51.41.D08.1.454.CMB.1.raw
  modified_base (131)..(132): a, c, t, g, unknown or other
  misc_feature (131)..(132): n is a, c, g, or t
tcagcgatcgtatacacgaccggtgctcgatttagtcacgcgagaaagggaaggggctggcaaggcgcatagctgcctggtcaaggactacttcctcgtagcactctgagcgggctggcaaggcgcatagnn

SEQ ID NO: 44716 - DNA, 128 bp, Homo sapiens
  misc_feature: GYAE6OF02JJ0IA.51.41.D08.1.454.CMB.1.raw
  modified_base (127)..(128): a, c, t, g, unknown or other
  misc_feature (127)..(128): n is a, c, g, or t
tcagcgatcgtatacacgaccggtgctcgatttagtcacgcgagaaagggaaaggggctggccctgacgtgtttctgttcccgccctcctctcgtagcactctgagcgggctggcaaggcgcatagnn

SEQ ID NO: 44717 - DNA, 146 bp, Homo sapiens
  misc_feature: GYAE6OF02FJ1MZ.51.41.D08.1.454.CMB.1.raw
  modified_base (134)..(146): a, c, t, g, unknown or other
  misc_feature (134)..(146): n is a, c, g, or t
tcagcgatcgtatacacgaccggtgctcgatttagtcacgcgagaaagggaaagggggctgggcaaggcgcatagctgcctggtcaaggactacttcctcgtagcactctgagcgggctggcaaggcgcatagnnnnnnnnnnnnn

SEQ ID NO: 44718 - DNA, 129 bp, Homo sapiens
  misc_feature: GYAE6OF02F73VN.51.41.D08.1.454.CMB.1.raw
  modified_base (128)..(129): a, c, t, g, unknown or other
  misc_feature (128)..(129): n is a, c, g, or t
tcagcgatcgtatacacgaccggtgctcgatttagtcacgcgagaaagggaaagggggctggccctgacgtgtttctgttcccgccctcctctcgtagcactctgagcgggctggcaaggcgcatagnn

SEQ ID NO: 44719 - DNA, 501 bp, Homo sapiens
  misc_feature: GYAE6OF01BVW3Q.19.67.G01.1.454.CMB.1.raw
  modified_base (232)..(232): a, c, t, g, unknown or other
  misc_feature (232)..(232): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaacttctagcctggtaccaacagagaccaggacagcctcctaggctgctcatttactggcatctacccgggaatccggggtccctgaccgattcagtggcagcgggtctgggacagatttcactctcaccatcagcagcctgcaggctgaagatgtgctagtttatattgtcaactaatattattatacttcgtgacgttcggaccaagggaccaaggtggatatnaagacgaactgnggctagcacntctcg

SEQ ID NO: 44720 - DNA, 496 bp, Homo sapiens
  misc_feature: GYAE6OF01DS1HE.19.67.G01.1.454.CMB.1.raw
  modified_base (231)..(231): a, c, t, g, unknown or other
  misc_feature (231)..(231): n is a, c, g, or t
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcgggacatcgtgatgacccagtacccagactcactggctgtgtctctgggcgagacggccacaatcaactgcaggtccagccagaacattttcnccacctccaagaacaaaaacttcttaagcctggtaccaacagagaccaggacagcctcctaagttgctcatttactgggcttctacgcgcgaattcgggtccctgaccgattccgggcagcgggtctgggacagatttcactctcaccatcagcagcctgcaggctgaagatgtggctagtttatactgtcagctaatattttctatcctcgtgacgttgcaaggaccaggtgaatcgagagaactgnggctgcacntctgtctc

SEQ ID NO: 44721 - DNA, 879 bp, Homo sapiens
  misc_feature: GYAE6OF01D4N9Z.19.67.G01.1.454.CMB.1.raw
tcagtactctcgtgcacgaccggtgctcgatttagagtatacatattgggggtttaggggggagaggagccctagcactgggagttccgaggtagtttccagttcggtgcgtcaagcactgaacacaggacgggacttccaccacttcggtacgtttttcggccttgaccttgggttttccttggcctgcgtaacttttcgacggaggtgtccgagtgtgaggtgcaactcggtggagacgtggcgggaccggcttggtccgagccctgggccgttcttcgtgaggacgtgtacctgtacgaaccctcgtagggggttacttccgtcaagtcctaggtcgacctggtacttacgccccgtaggggtaccgccgaccgggaccttccccgaaggggaacgtacgggacccgggaaggtaggggtacgccgtaagggttacgttttttaaccgtaggggtacgggggacccgtaacgaacgtttccttaccgggagtaccgtccctaacgtaggggtacggggtcccggaactttcccaacccacgttcccttccccgaaggtaaccgtaaccttttttccgacggtaacgggtaaccctaacccggtaccgttaggttaccttacgtttaccgaaaactttcggaaaaccttacgtacccgtttagggacggggaccccggaaagggtacccgaaccggggggtacccgttaccgttaaatttaggtttacgggttaggttacggtaaacggtacggtttttaacgtgggggtaccggtaagggtttcgggggtccgtttcggggggttacggggaaacccggtaacggtaaacgttaccggaaacccgggtttcggggggaacccgtaaacccgggggg

SEQ ID NO: 44722 - DNA, 557 bp, Homo sapiens
  misc_feature: GYAE6OF01BVFST.19.67.G01.1.454.CMB.1.raw
  modified_base (503)..(503): a, c, t, g, unknown or other
  misc_feature (503)..(503): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctggggtctccgtcagcagcgactgtattgcctgggtccgccaggctccgagggaagaggccggaggtgggtcgcgaggttatttttagtagggttgggacgacattctacggagactccatgggagggccgattcgaccagtctccagagtacttttctcagaacacactgtctcttacaaatgaacagcctgacgggccgaggaccgaccggccgtattacttattgtgtgagtagtttagnggtcgtagtcggtcgtggtaggacgagactacgacgtggggccgtaaaccgggg

SEQ ID NO: 44723 - DNA, 566 bp, Homo sapiens
  misc_feature: GYAE6OF01C28JZ.19.67.G01.1.454.CMB.1.raw
  modified_base (557)..(557): a, c, t, g, unknown or other
  misc_feature (557)..(557): n is a, c, g, or t
tcagtactctcgtgcacgaccggtgctcgatttagagtatacatattgggtttggggggggagaggagcccagcactgggattccgaggtgtttccattcagtgatcagcactgaacacagaggactcaccatggagttgagactgagctggtatttttccttttggctattttaaaaggtgtccagtgtgaagtgcagctggtggagtcgtgggggagcttggtacagcctggcaggtccctgagactctcctgtgcagcctctggattccacctttgatgattatcgccatgcacgtggggtccggcaagcctccgaggggaacgggccgtgggagtgggtctcgaggttatttaggttaggaatagtgcttagtatagcctagtcgcggtactcgtggtaggaacgggccgtattccaacctatcctaccgaaggacgaaccaaccgacccaaagacctccctagtactctagacaaatgaactgtctagagagcgtaggacggacgacggtccgttagtattacgtgtacgacgaaagggtaggtaatagacnggtctacgg

SEQ ID NO: 44724 - DNA, 593 bp, Homo sapiens
  misc_feature: GYAE6OF01CWVVN.19.67.G01.1.454.CMB.1.raw
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagtactctcgtgcacgaccggtgctcgatttagagtatacatattgggcttggtccagcctgggcggtctctgagactgtcctgtgaaccctctgggtctccgtcagcagcgactgtattgcctgggtccgccaggctccagggaagaggccggagtgggtcgcaggtattttttataggtgggacgacattctacggagactccatgggagggccgattcaccatctccagagacttttctcagaacacactgtctcttcaaatgaacagcctgagggccaggacacggccgtctatttatttgtgtgagtagttttatgggcgatggctggtggacaggatcacgtggggccagggaaccctggtcaccgtctcctcagccctccaccgaacgggcccacgtcggtccttcccccgtggccgcccctcgctccgacggcgccacccgtccgagacgccacgacgccgggcccgtcggggctcggcccgttgggtaccaacgggtaccttaacccgttccccgaacggtaacgtacggtacgtacgggacggcggggcgtcgggacgaacgggccgacagtaggngngng

SEQ ID NO: 44725 - DNA, 510 bp, Homo sapiens
  misc_feature: GYAE6OF01DOCAA.19.67.G01.1.454.CMB.1.raw
  modified_base (238)..(238): a, c, t, g, unknown or other
  misc_feature (238)..(238): n is a, c, g, or t
  modified_base (506)..(506): a, c, t, g, unknown or other
  misc_feature (506)..(506): n is a, c, g, or t
tcagtactctcgtgcacgaccggtgctcgatttagagtatacatattgggtttggtggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaaacttcttaagcctggtaccaaacagagaccaggacagcctacctaagttgctcatttactgggctttctaacgcgcgaaattcggggtccctgaccgattccggggcagcgggtctgggacagatttcactctcaccatcagcagcctgcaggctgaagatgtggcagtttatactgtcagcaatatttttctaatcctcgtgacgttcgcaaggacagggtgaaatcaagcgaaactgtaggctgcacngtcg

SEQ ID NO: 44726 - DNA, 577 bp, Homo sapiens
  misc_feature: GYAE6OF01AZE8R.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctggggtctccgtcagcagcgactgtattgcctgggtccgccaggctccgaggggaagagggccgggaggtgggtcgcgagggttatttttagtagggtggggacgacgatttcgtacggagactccgatggagggccgattcgaccatctccagtagtacttttctcagaacacactgtcctcttacaaatcgaacagcctaggacgggccgaaggaccgacgggtcccgtacttattagttgtgttggagttagtttagtgggcgtagtgggcgttgggtggaacgtagactcgacgtgggggccgtaaccggggg

SEQ ID NO: 44727 - DNA, 525 bp, Homo sapiens
  misc_feature: GYAE6OF01A3XX0.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcggtctctgagactgtcctgtgaaccctctggggtctccgtcagcagcgactgtattgcctgggtccgccaggctccagggagaggccggagtgggtcgcaggtatttttataggtgggacgacattctacggagactccagtggagggccgattcaccatctccagagactttctcagaacacactgtctcttcaaatgaacagcctgagggccgaggacacggccgtctattatgtgtgagtagtttatggcgatgggctggtggacagatcacgtggggcctaacgggg

SEQ ID NO: 44728 - DNA, 563 bp, Homo sapiens
  misc_feature: GYAE6OF01CVUEY.19.67.G01.1.454.CMB.1.raw
  modified_base (412)..(412): a, c, t, g, unknown or other
  misc_feature (412)..(412): n is a, c, g, or t
tcagtactctcgtgcacgaccggtgctcgatttagagtatacatattgggtttgggggggagaaggagccccagcgactgggattccgaggtgttccattccggtgctcagcactgaacacagaggactcaccatggagtttggctgacctgggttttccttgctgcaatttcaggaggtgtccagtgtgaggtgcaactggtggagacgtggcggaggcttggtccagcctgggcggtctctgagtactgtcctgtgaacctctggggtctccgtcagcagcgactgtattgcctgggtccgccaggcctccgagggaagagggccggaggtgggtcgcgaggtattttagtaggttgggacgacatttctaacggagactccatgggagggccgattcaccatctccagngactttcacagacacactgtctctacaatgaacagcctggagggccgaggaccgacgggtccgttatagttattgtgtagtagttagtttagtgggtcgtagttgggcgttgggtaggacgtaggactcgacggtggggccctaaccgggg

SEQ ID NO: 44729 - DNA, 770 bp, Homo sapiens
  misc_feature: GYAE6OF01BTLQR.19.67.G01.1.454.CMB.1.raw
  modified_base (299)..(299): a, c, t, g, unknown or other
  misc_feature (299)..(299): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttcctgctgcaattcaggagtgtccagtgtgaggtgcaactggtggagactgggcggaggcttggtccaggcctgggcggtctcgtgagactgtcctgtcgaacctcgtggggtctccgtcagcagcgactgtattgcctgggtccnccgaggcctccgagggaagacggccggaggtgggtcgcgtaggttactttttagagggttgggacgactagttcgtaacggagaccgtccgaagtggggacgggccgtaattccgaacctacgtaccgtccaaggtaacgtacctttttccgacgtaacggaaacctaacctaaccgtttggttacccttactttaccgtaaaaacgtttcggaaaacctacggtacccgttacgggaacgggggtaccccgaaaggggtaaccccgaaccgggggtaccccgtttaacgtttaacgttttaacggttttcggttacggttacgggtaacggtttaagggtttttaacgtacgggggtcgtaaaggtttcgggggtcccgtttagggggttaacggggaaacccgttaacgggttacgttaacccgggaaccgggttcggggggggtacccccgttaaaaacccggggggg

SEQ ID NO: 44730 - DNA, 694 bp, Homo sapiens
  misc_feature: GYAE6OF01C7H5D.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatgacccagtacccagactcactggctgtgtctcgtgggcgagacggccaacaatcaactgcaggtccagccagaactattttccaccaccctacaaacgaaactaaaaacttcttaacgcctacggtaaccaacagacgaccgaggacacgcctacctaagtcgctctatttacgtggtcttacgtacggcgtacggtaacgttccggggtccctacggacccgtacggttcccgggggacacgggtccggggttctacggggaactaggtacttttaccgaccttctaccacctataccagccacgtcctaggacaggtctaaggaacgtagttgggttcgaccgttaagttttacttacgtacgtcgaagtaactttaattttacttttttacgttactcccgttccggttacgggtacccgttccgggaaccggtaaaccgggacggtaggggttaaggaaaaccttcgaaacggtaacccggtaaacgttcgggtacggtacccgttacgaccctaaacctgtttccgttacg

SEQ ID NO: 44731 - DNA, 716 bp, Homo sapiens
  misc_feature: GYAE6OF01DZEG5.19.67.G01.1.454.CMB.1.raw
  modified_base (241)..(241): a, c, t, g, unknown or other
  misc_feature (241)..(241): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagaccggccaacaatcaactgcaggtccagccagaactattttccnccacctacaaagaaactaaaacttctacgcctaggtaccaanagacaccagacacgcctctaagttnctctatttacgtggcttcgtacgcgtacgtaacgtttccggggtccctcggaccggtacggttcccgggggacctacgggtccggggtttccgtaggggaccgtaagttacttttcccgaaccgttccgtacccaaccctagttacccgaacggtacctaacggtccccgttaggaccgtacgggtactaagggaaacgtacgttagggttacgggttaccttacgttttttaactaccgttagtaccagttacttaaattttcgtttttacctactttcccgttacggttacggtaccggtttccggacccgtaaaggggtacccgtaaggggttacgaaacgttccgaaacggtaaccgtaacgttggtacggtacctacggaccctaaccgtcgttcgttacccg

SEQ ID NO: 44732 - DNA, 711 bp, Homo sapiens
  misc_feature: GYAE6OF01C2F32.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctcgtggggtctccgtcagcagcgactgtattgccgtcgggtccgccgaggctccgaggggtaaggacgggaccgggaggtggggtcgcgtaggttattttagtaggtggggacgacgtagttcgtaacggagactccgagtcgggaggaccgtatccaacctatccgtaccgaaggtacgtacgttttcctacgtaacggtaaactactaccttcggttaccttctttacgaaacgttacgaaccgtacggtacccgttaggtaaccggggaacccggtaacggggtaaccgtacccgggtacccgttaaccgtttaacggtttaacgtttacgggttaggtacgggtaaggttaaacgggttttttaacgtgggttacggtaaggttcggggtacgtttagggggtacgggaacgtagggtaacttccggtaacgggttaacccgggggg

SEQ ID NO: 44733 - DNA, 824 bp, Homo sapiens
  misc_feature: GYAE6OF01C9B3F.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcgaggaggtgtccagtgtgaggtgcaacgtggtggagacgtgggcggagcttggtccaggccgtggggcggtctcgtgagactgtcctgtgaaccctcgtcggggtctccgtcgacgcagcgtactgtattcgccgtgggtccgccgacggccgtaccggagggaagacgggccggtaggtcgggtcgacgtaggttattttaggaggtgggacgtaactagttccgtaacggagaccgttacgagtagggacgggtccgtaattccgaccgtaacttccgtacccgaagtacgtttaacttttaccgtacaaacggtaaacctaccgtaaccgtttcggttaccttacctttaaccgaaaacgtttacgaaaccgtacggtacccggtagggaaccggggtaccccggaaacggggaacccgtaacccgggggttaccccttttacggttaaccgtttttaggttttaccggttagggttaacgggttaaagggttaaccgggttttttaaagggtaggggttaacccgggttaaggggtttccgggggtttaacccgggtttaggggggtttacccggggtaaaaaccggtttaccgggaaaaccggtttacccggggtaaaccccggggttttaaccccgggggggggg

SEQ ID NO: 44734 - DNA, 669 bp, Homo sapiens
  misc_feature: GYAE6OF01DG5CH.19.67.G01.1.454.CMB.1.raw
  modified_base (234)..(234): a, c, t, g, unknown or other
  misc_feature (234)..(234): n is a, c, g, or t
  modified_base (319)..(319): a, c, t, g, unknown or other
  misc_feature (319)..(319): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagactattttccnccacctcaagaaactaaaacttcttaagcctaggtaaccaacagacgaccaggacacgcctacctaagtttcgctctatttacgngggtcttctacgcgacgtaagttccggggtccctggaccgtagttcccggggcaggtccggggtctggggaacctaggtactttccgaaccttcccgtacacctacgtacgacgcgacgtccgtacgacgacggtctaagaagtgtggtcgtacgtttaagtttactacgtcgtacgaacgtaattaatttttcttttacgttaccgttcccggttacgggttacgggttacccgttaccggaaccgggtaacgggtaaccggtaggggtaacgtaaacgtacggaaccggtaacggtacggttcgggtcgtcgacgtacctaaccgttagttccgttcgttccttaccg

SEQ ID NO: 44735 - DNA, 634 bp, Homo sapiens
  misc_feature: GYAE6OF01DCLDG.19.67.G01.1.454.CMB.1.raw
  modified_base (320)..(320): a, c, t, g, unknown or other
  misc_feature (320)..(320): n is a, c, g, or t
  modified_base (614)..(614): a, c, t, g, unknown or other
  misc_feature (614)..(614): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcggtctcgtgagactgtcctgtcgaacctcgtggggtctccgtcagcagcgactgtattgcctgggtccgcaggctccgaggaagnggccggagtgggtcgcgaggttattttagtagggtgggacgactagttacgtaacggagtactccgagtcgggacgggtcccgaagtttccaaccgattccgtacctagacgttaccttttcgtacaagtaaccaactacgttcgtacttactttacaaaactgaaccagtccgtaggacgggccggaagggaccgaccgggtccgtacttagtttaagttcgtaggttagtaggtagttttagcgggtacgtattgggtcgttgggtacggacgtaggtaactccgtaacggnggggcccggtaaaccggggg

SEQ ID NO: 44736 - DNA, 741 bp, Homo sapiens
  misc_feature: GYAE6OF01B5ZME.19.67.G01.1.454.CMB.1.raw
  modified_base (574)..(574): a, c, t, g, unknown or other
  misc_feature (574)..(574): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatgggagttttggctgaccttgggttttcctgctgcaatttcaggaggtgtccagtgtgaggtgcaagtggtggagacgtgggcgggaggtcgttggccaggtccgtgggcggtctcgtgacgtacttcggtcctggttcgaaccctcggtcggggtcctccgtacgagcaggcgtacttgtacgttcgccggtcgggtcccgcgacggccgtaccggaagggaacggacgggccgggtaggtcggggtccgtacggtaggtttaagtttttagtacggggtaggggtaaccgtacgtagtttacggtaacggaagtaccgttaccgaaggttcggggaacgggtccgtaagtttcccaacccgaacgttccgtacccgaaggtacgtttaccgtttttaccacgtaaacggaaacctaacctacgttccgttacttacttaanaaacgtagaaccacgtcgtacggacgggtaccgacggacgaaccgggtcccgtattacgttaagttgtaggtacggtaaggttacgtttaaggtggtacggtagttcgggtgtaggggttacgaacgtggttaacgccgtaacgggtcgggggcccgtaaaccgggg

SEQ ID NO: 44737 - DNA, 570 bp, Homo sapiens
  misc_feature: GYAE6OF01BAAFX.19.67.G01.1.454.CMB.1.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgaggtgcaagtggtggagactgggcggaggcttggtccaggcctgggcgtctcgtgagactggtcctggtcgaacctcgtgggtctccgtcagcagcgactgtattgccgtgggtccgccgaggctccgagggaagaggccggagtgggtcgcgaggttatttttagaggtgggacgactagttcgtacggagacgtccgaagtgggagggccgagttcacctatctccgagtagtacttttcacagaaacacactgtctcttacaaatgaacagcctgagggccgaggaccacgggccgtatagttacgtgtagtcgtagtaggtttatggtcgatgggtctgggtggacctagacgttaccgacgttcggggccgtaaacgggg

SEQ ID NO: 44738 - DNA, 771 bp, Homo sapiens
  misc_feature: GYAE6OF01AJZQQ.19.67.G01.1.454.CMB.1.raw
tcagtactctcgtgcacgaccggtgctcgatttagagtatacatattgggtttggggacaacgaggcacggtctaggggcagctaagatggtggttgcgagacccaggtccttcatttctctgttgctctggactcttcgtggttcctgcgggacatcgtgatgacccagtacccagactcgacttggctgtgtctcgtggcgagacgcctacaagtcaactgcaggtccagccagtactatttctccaccgtcaagaacaaaacttctacgccgtggtaccaacagagaccagaccagcctcctaagtttcgcctctactttacctcggtactttactacgacgacgtaagttccggggtccctggacccgacgttcccggggctacgggcgggtccgtaggggacctaggtactttccgacgttccgttaccgaaccctacgttcccgaaggtcccgtaacgggtaccccttagggaaccgtaagggtccctaaggtaaaacgttaacgttagggttcgggaaccttaacggtttttaatttaacccgttggttaccgaacgggtaccttaaaagttttcttttttaccttaacgtttccccgtttacccgggttacggttaaccggtttacccgggacccgtaaaacggggtaccccgtaaaggggttaacggtaaaaccgttcgtaaacggtaaccgtaaacggttcggttaacgggtaccctacggtaccctacccgtaattcccgttacggtttccgttaacccg

SEQ ID NO: 44739 - DNA, 566 bp, Homo sapiens
  misc_feature: GYAE6OF01AEZWJ.19.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaacttcttagcctggtaccaacagagaccaggacagcctcctaagttgctcatttacngggcttctacgcgcgtaagttccggggtccctgaccgagttcccggggcaggcgggtctgggacagtatttcactctcaccatcagcagcctgcaggctagaagntggtggctagttttattactgtacagtctaattctttttctacttccgttccgtggtaccgtttccgggactaacggggtaccgaggggttacggaaacttcgaaggtaccgtaacgtggtacggcttaggaccctacctgtcgttacg

SEQ ID NO: 44740 - DNA, 535 bp, Homo sapiens
  misc_feature: GYAE6OF01BCI0V.19.67.G01.1.454.CMB.1.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaacttctagcctggtaccaacagagaccaggacagcctcctaagttgctcatttactgggtcttctacgcgcgaattccggggtccctgaccgagttccggggcaggcgggtctgggacagtatttcactctcaccatcagcagcctgcaggctgaagntggtggctagtttatactgtcagctaattcttttcttacttcccttcggtggtaccgttcggaccgaagggaccaggggtagaaatcgaaggacgaacgtggtcggctgaccactagtctcg

SEQ ID NO: 44741 - DNA, 701 bp, Homo sapiens
  misc_feature: GYAE6OF01CA2QW.19.67.G01.1.454.CMB.1.raw
  modified_base (235)..(235): a, c, t, g, unknown or other
  misc_feature (235)..(235): n is a, c, g, or t
  modified_base (368)..(368): a, c, t, g, unknown or other
  misc_feature (368)..(368): n is a, c, g, or t
tcagtactctcgtgcacgaccggtgctcgatttagagtatacatattggttttgggacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaactattttccnccacctacaaagaactaaaaacttcttagcctaggtaccaacagagaccaggacagcctacgtaagtcgctctatttacgtggcttcacgcgacgtaacgttccggggtccctagaccggtagttcccggggnacgggccgggtcgtgggacctaggtacttttccgacttcctacaacccagtccgaggacctacgtccccgtggaccgagggtcctaggaaaggtcgttgggtacgggtacctttaaggttttacttaccgtgtaccgtaaggtaaccttaagtttttacttttttacccgtacgttcccccgttaccggttacgggttaaccccggtttaccgggacccggtaaacgggggtacccgtaagggggtaccggtaaaactccggaaacggtaccggtaacttcggggtacggtcgtacggtaccctaaccgttattccgttcgttacccttaccg

SEQ ID NO: 44742 - DNA, 555 bp, Homo sapiens
  misc_feature: GYAE6OF01AOA9V.19.67.G01.1.454.CMB.1.raw
  modified_base (448)..(448): a, c, t, g, unknown or other
  misc_feature (448)..(448): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctgggcggtctctgagactgtcctgtcgaaccctctggggtctccgtcagcagcgactgtattgcctgggtccgcaggctccgagggaagaggccggagtgggtcgcgaggtattttagaggttggggacgacattctacggagactccatgggaggccgattcgaccatctcccagagtacttttctcagaacactaactgtctcttacaaatgaacngcctaggacgggccgaggacacgggtccgtactattactgtgtgagtagttagtggtgtagtgggctgggtaggactaagatacgacgttgggggcctaaccggggg

SEQ ID NO: 44743 - DNA, 892 bp, Homo sapiens
  misc_feature: GYAE6OF01EAA8K.19.67.G01.1.454.CMB.1.raw
tcagtactctcgtgcacgaccggtgctcgatttagagtatacatattgggtttgggggagctacaaacaggcaggtcaggggcaagcaacgagtggtgttgcagacccaggtcttcattttcgtctgttcgctcttggattctcgtggttcctggcgggacatcgtgatcgacccacgtaccgagactcgacgtggctgtggtctcgtggggcgagacggccacgaacttcaacgtggcacggtccacgaccgtagtaactacgttttccacccaccttaccaaagaaacctaaaaaacctttcgtttaacgtcccttaagggttaacccgaaacgacggaacggacccaacgggaaccacgacccgttaccgtttaaaggttcggaccgttacgtaaggttttaaccgtcggggtaccttttaccgtaacggtccggtacggtaaacgtttcccggggtaacccctacggaacccgtacggttaccgggggactaacggtccggggtacgtacggggaactacggtactttacccgaacttaccgtaccgaaccttaaagtaccgaacgtacgtaacggtacccgttaggaccgtaacgggtaccttaagggaaaacgtcgttacgggttacggaaccttttaacgggtttttaacgttaaccggtacggttaccggtaacgtttaacctttaaacgttttttcgttttttaccgttacgttacccggttaccgggttaacgggttaacccggttttaccgggaaacccgtaaacggggtaccgttaacgggggttaacgtttaaaccgttacccgtaaacggtacccggttaaacgttcgggttcgggtaccgttacgtaacccctaccggttaccgttcctttacccgg

SEQ ID NO: 44744 - DNA, 721 bp, Homo sapiens
  misc_feature: GYAE6OF01ETKCN.19.67.G01.1.454.CMB.1.raw
  modified_base (235)..(235): a, c, t, g, unknown or other
  misc_feature (235)..(235): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctggcggggacatcgtgatgacccagtacccagactcactggctgtgtctcgtgggcgagacggccacaatcaactgcaggtccagccagaactattttcnccacctaccaaagaaaccaaaaacttcttacgcctaggaaccaacagacgaccaggacagccctactaagttcgcttcaactttacgtgggccttcgacgcgacgtaacgttccggggtcccctggtacccggtagttcccggggctacgggccggggttacgtggggaactaggtacttttccaaccgtccttaccgaacctacttccgaacggccaacggtccctggaccgtacggggacctaggaaacgtgttacggtacggtacctttaaggttttaacttaccgttgtaccgtaacggtacttaaagttttacttttttacccgttaacttccccggttccgggttacgggttaaccggtttcccgggaacccggtaaaggggtaccccgtaagggggttacggtaaaacgtcggaaacggtaacggtaaccgttgggtacggtcgtacggacctaaccgtagtttcctggttccttaccg

SEQ ID NO: 44745 - DNA, 541 bp, Homo sapiens
  misc_feature: GYAE6OF01A12O1.19.67.G01.1.454.CMB.1.raw
  modified_base (420)..(420): a, c, t, g, unknown or other
  misc_feature (420)..(420): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagagggccggaggtgggtcgcgaggttattttagtaggtgggacgtacattctacggagactccagtgggagggccgattcaccatcctccagagtacttttcncagaacacactgtctcttcaatgaacagctggagggccgaggacacggcctactattatgtgtgagtagtttagtgggacgtgtgggcgttgggtacggacaggactcgacggtcgggggg

SEQ ID NO: 44746 - DNA, 698 bp, Homo sapiens
  misc_feature: GYAE6OF01DCWZ9.19.67.G01.1.454.CMB.1.raw
  modified_base (250)..(250): a, c, t, g, unknown or other
  misc_feature (250)..(250): n is a, c, g, or t
  modified_base (338)..(338): a, c, t, g, unknown or other
  misc_feature (338)..(338): n is a, c, g, or t
  modified_base (691)..(691): a, c, t, g, unknown or other
  misc_feature (691)..(691): n is a, c, g, or t
tcagtactctcgtgcacgaccggtgctcgatttagagtatacatattgggtttgggggagctacaacaggcaggcaggggcagcaagatggtgttgcagacccaggtcttcattttctctgttgctctggatctctggttcctggcggggacatcgtgatcgacccagtacccagacctcactggctgtgtctcgtgggcgaggacggccacaatcaactgacaggtccagccaagtaactacttttccnccaacctaccaaagtaaactaaaacttctacgcctaggtaaccaacagacgaccgaggacacgcctactaagtcgactctatttacgnggtccttcgtacggcgtacgtaaggttccgggtacctaggaccggtaggttccggggctagggtccgggtacgtacgggactaggtactttccactttaccacacctataccgacggccaacggtcctaggacccgtagggtctaaggaaacggtgttcggggtacgtaaccgtttaggtttttaacttaccggtggtactaacggtaacctttaacgtttttctttttaccgtaaccttcccggtcggtttacgggtaccggttaccgggaacggtaaacggggtaccgtaaggggtacgtaaaactcggaacggtaccgtaagttcgggagtaccctaggaccttaccgtntcgttcg

SEQ ID NO: 44747 - DNA, 595 bp, Homo sapiens
  misc_feature: GYAE6OF01BOXUX.19.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (436)..(436): a, c, t, g, unknown or other
  misc_feature (436)..(436): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaacatttcnccacctccaagaacaaaacttctagcctggtaccaacagagaccaggacagcctctaagttgctcagtttacgngggcttctacgcgtacgaagttccggggtccctggaacccgtagttcccgggggcacggtcgggtcgtggggacaggtatttccaacgttctacaccatcagccagccctgcaggctaggaagntggtagactagtttatacgtgtaccagtctaatttactttttcgtacttcccgtcggttaggaccgtttccggacccgtaacggggacctaggggtacgaaattccgaaggtaccgtaacgttgggtcggtactacggacctacccgtattccgttacg

SEQ ID NO: 44748 - DNA, 580 bp, Homo sapiens
  misc_feature: GYAE6OF01EB9W9.19.67.G01.1.454.CMB.1.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (318)..(318): a, c, t, g, unknown or other
  misc_feature (318)..(318): n is a, c, g, or t
  modified_base (569)..(569): a, c, t, g, unknown or other
  misc_feature (569)..(569): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagcggccacaatcaactgcaggtccagccagaactattttcnccacctaccaaagaacaaaacttctagcctggtaccaanagagaccaggacacgcctcctaagttgctctagtttacgnggtcttcacgcgacgtagttccggggtccctgacccgtagttccggggcacggcgggtctgggacagtactttcgactcctcacatcagcagcctgacgtagctgaaagcttgcggtactagttttactacgtcgtacgagtactaaattttctttttactactcccgttcggtaggtacgtttcccgggacgtaaacgggtaccgtaggggtagtaaactcgaggaccaacgtggtcggcttcgaacccnctagtgttacg

SEQ ID NO: 44749 - DNA, 871 bp, Homo sapiens
  misc_feature: GYAE6OF01C6SAR.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcacatggagtttggctgacctgggttttccttgctgcaatttcaggaggtgtccagtgtgaggtgcaacgtggtggagacgtgggcggaggcttgggtccaggccgtggggcggtctcgtggagactgtcctgtcgaccctgtggggtctccgtcagcagcgactgtagttcgccgtcgggtcccgccgaggccgtaccggaaggggaacgacgggccgggaggtcgggtcgacgtaggtttaagttttaggtagggtcgggaacgtactacgttcgtaacgggacgtaccgtaccgtaggtacggggacggggtacccgtaacgtttaccgaacccgtacgttacccgtaccgtaacggtaaccggtttaacccttttttaccgtaaccgtaaacggtaaacccgtaacccgttaaccgtttcggtttaccctttaacccgtttaaaccgtaaaacgtttaaccggaaaaccggtaccggtacccggttaacggggaacccggggggttacccggaaacccggggaacccggtaacccggggtaccccgtttaacgtttaaccggtttttaaggtttacggggtttacggttagggttaaacggttttaaacggggtttttttaacggaccgggggtttacgggttaacggttaccgggggttaccggttttacgggggtaacggggtaaaccgtaagggttaacccggttccggggtaaaccggggtacccccgggggggg

SEQ ID NO: 44750 - DNA, 576 bp, Homo sapiens
  misc_feature: GYAE6OF01BHACT.19.67.G01.1.454.CMB.1.raw
  modified_base (324)..(324): a, c, t, g, unknown or other
  misc_feature (324)..(324): n is a, c, g, or t
  modified_base (568)..(568): a, c, t, g, unknown or other
  misc_feature (568)..(568): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggccagcctggggcgtctctgagactgtcctgtgaaccctcgtggggtctccgtcagcagcgactgtattgcctgggtccgccgaggctccgagggaaggngggccggaggtgggtcgcgaggttagttttagtaggtgggacgactagttcgtacggagactccgagtgggaggccgattccgacctatccgtccgaagtacgtaccttttcgtacaacgaacaccgtacgtctcctcttacaaactcgaactagccgtagacgggccgagggaccgaccggcgtactagttagttgtagtgagtagttagtgggcgtagtggcgtgggtggacgagacgtcgnggtcgggg

SEQ ID NO: 44751 - DNA, 572 bp, Homo sapiens
  misc_feature: GYAE6OF01DBVZH.19.67.G01.1.454.CMB.1.raw
  modified_base (512)..(512): a, c, t, g, unknown or other
  misc_feature (512)..(512): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttggtccagcctggggcggtctctgagactgtcctgtcgaaccctcgtggggtcctccgtcagcagcgactgtattgcctgggtccgccaggctccgagggaaggacggccggaggtggggtcgcgtaggtatttttagtagggtgggacgacagtttcgtacggagactcgagtgggagggccattccaccatctccagagtactttcacagaacacactgtctcttacaatgaacagcctggacgggccgaaggacacgggtcctactatttactgtgtgagtagttagnggtcgagtggcgttgggtaggacgtaggacgttcgacggtggggcccgtaaacccggggg

SEQ ID NO: 44752 - DNA, 536 bp, Homo sapiens
  misc_feature: GYAE6OF01D62K5.19.67.G01.1.454.CMB.1.raw
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattggggtttggggggagaggagcccagcactgggattacgaggtgtttccattcggtgctcagcactgaacacagaggactcaccatggagttttggctgacctgggttttccttgctgcaatttcaggaggtgtccagtgtgaggtgcaactggtggagactgggcggaggcttggccagccgtgggcgtctctgagactgtcctgtgaaccctctggggtctccgtcagcagcgactgtatgcctgggtccgccaggctccgaggggagaggccggagtgggtcgcaggttattttagaggtgggacgacattctacggagactccgatgggagggccgattcaccatcctccagacgactttttcacaagaacactactgtctcttacaaatgaacngcctgacgggccgaggacacggcctntattatgtgtgagtgtttanggcgtatgggctgggtgaactagactcacgtggggcctaacgggg

SEQ ID NO: 44753 - DNA, 624 bp, Homo sapiens
  misc_feature: GYAE6OF01ASSQG.19.67.G01.1.454.CMB.1.raw
  modified_base (440)..(440): a, c, t, g, unknown or other
  misc_feature (440)..(440): n is a, c, g, or t
  modified_base (556)..(556): a, c, t, g, unknown or other
  misc_feature (556)..(556): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactggcggaggcttggtccagcctgggcggtctctgagactgtcctgtgaaccctctggggtctccgtcagcagcgactgtattcgcctgggtcccgccaggctccgagggagaggccggaggtgggtcgctaggtatttttagagggtgggacgacagtttcgtaacggagacctccgagtcggggacgggtcccgaattcgaccctagtccctccaggtacgtactttttcncacgaaactaccaacttgtaccttcttacaaaattcgaaccaggtccctggacggggtccggaagggaccgaccgggtccgttacttagtttagttgtggtagaggttagtttagngggtcgtagtgggtccgttggggtggaactacgggtattccggaacggttgggggaccctaacggggg

SEQ ID NO: 44754 - DNA, 534 bp, Homo sapiens
  misc_feature: GYAE6OF01EMOJL.19.67.G01.1.454.CMB.1.raw
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
  modified_base (490)..(490): a, c, t, g, unknown or other
  misc_feature (490)..(490): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctcccgagggagaggccggagtgggtcgcaggtattttagtaggtgggacgacattctacggagactccagtggaggccgattcaccatctccagagacttttcncaagaacacactgtctcttcaatgaacngcctgacgggccgagggaccacggccgtctattattgtgtgagtagtttntgggcgtagtggcgtgggtcggacaggactcgaggtaccggggg

SEQ ID NO: 44755 - DNA, 611 bp, Homo sapiens
  misc_feature: GYAE6OF01AQB2R.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctgggcggtctctgagactgtcctgtgaaccctctggggtctccgtcagcagcgactgtattgcctgggtccgccaggctccgagggaagaggccggaggtgggtcgcgaggtattttttacgagggttggggacgacatttacgtacggagactccgagtgggagggccgattccaccatctccagagtacctttttctaccagaaacacacttcgtcttaccttacaaattgaaccagacctagggaacgggtcccggaagggaccgaccgggtacccgttacgttaactttagttcggtgttaggtacgtaggtttacgtgggtacgtagttgggcgttgggtggactagtactacgacgtcgggggcctaaaccggggg

SEQ ID NO: 44756 - DNA, 603 bp, Homo sapiens
  misc_feature: GYAE6OF01CCCMB.19.67.G01.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttcnccacctccaaagaacaaaaacttcttagcctaggtaccaacagagaaccaggacagcctcctaagttcgctctatttacgngggtccttctacgcgcgaacgttccggggtccctggaccgtacgttccggggcaggcggggtctggggacagtactttcactctcaccatcagcagcctgcgagctagaagtagtgtgacttagtttatacctgtctagactaatttctttttactacttcccgttaccggtggtaccgtttacggaccgaacggggtacctaaggggtcgtaaaactcgaacggtaaccgtaacgttcgggacgtccgttacggaccctaaccgtagttccgtttggttcccttaccg

SEQ ID NO: 44757 - DNA, 613 bp, Homo sapiens
  misc_feature: GYAE6OF01ETV70.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggtttcccttgctgcaatttcaggaggtgtccagtgtgaggtgcaactggtggagacgtgggcggaggcttggtccagcctgggcggtctctgagactgtcctgtgaaccctcgtgggtcctccgtcagcagcgactgtattgcctcgggtccgccgaggcctccgagggaagagggccggaggtgggtcgcgtaggttattttagaggtgggacgactagttctaacggacgtactccgagtgggacgggaccgtattaccaccgtatccgttccaagtacgtacttttctacaacgaacctacactcgtaccttcttacaaatagaaccagccgtaggacgggaccgacggaccgacggtccgttctaactttacgttgtgttaggaagttaggtttaagtgggtacgtgttgggtcgttaggggtacggtacaaggtacgttcgtacggtaccggggg

SEQ ID NO: 44758 - DNA, 765 bp, Homo sapiens
  misc_feature: GYAE6OF01AT5VO.19.67.G01.1.454.CMB.1.raw
tcagtactctcgtgcacgaccggtgctcgatttagagtatacatattggggtttgggagaggagcccagcactgggattccgaggtgtttccattcggtgctcagcactgaacacagaggactcaccatggtagttttggctgaccgttgggttttccttgctgctaatttcgaggtaggtgtccagtgtgaggtgcgaacgtggtggagacgtgggcggaggtcgttggtccaggtccgtgggcgttctcgtgagtctgtcctgtacgacccgtcgtcgggtcctccgtcgagcgagcgtactgtacgttcgccgtcgggtcccgccgacggccgtaccggaaggggaacggacgggaccgggtaggtcgggtacgtacggttaaggtttaagtttttaggaacgggttacgggtaacgtacgtaagtttaccgtaacggtacgtacccgtacgtaaggttacggggacgggtacccgttaacgttacccgaacccgtacgttcccgtaccgtaacggtaacgttaaccgttttaccgtaccgtaacgtaaaccgtaacctaacgttacgttaccgttaccgttaacgtaaacgtaacgtaaccgtaacgtaccgtacgggaacgggaccggaacggaccggtaccggtaccgttacgttacgttagttagttaggtaggtagtaggtttagtaggtggtaggtggtggtacccccccggtaggacgtacgtacgtacggtacggtcgggtaccggtaaccggg

SEQ ID NO: 44759 - DNA, 662 bp, Homo sapiens
  misc_feature: GYAE6OF01EB9MA.19.67.G01.1.454.CMB.1.raw
  modified_base (242)..(242): a, c, t, g, unknown or other
  misc_feature (242)..(242): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagaccggccacaatcaactgcaggtccagccagaactacttttccncccacctaccaaagaaacctaaaaacctttcttaacgcccttaggtaacccaaacaagacgaacccaagggaaccacgccctaccgttaaaggtttcgaccttctattttaccgtgggtcctttacgtacgcgacggtaacgtttccgggggtcccctgacccggtagttcccgggggcacgggtcgggtctaggggacctagtactttccactcctcaaccatccagtccagcctgacaggctagaacgtagtggtacggcttagtttattacctggtcagactaatttactttttcttaacttcccgttcggtaggtacccggttcggacccgtaagggtacccggtaggggttagaaacgttgaacggtaaccgtaacgttgggtacgtaccgtacgacctaacctgttcccttcgg

SEQ ID NO: 44760 - DNA, 606 bp, Homo sapiens
  misc_feature: GYAE6OF01C0LZ0.19.67.G01.1.454.CMB.1.raw
  modified_base (317)..(317): a, c, t, g, unknown or other
  misc_feature (317)..(317): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtgggcggtctctgagactgtcctgtcgaaccctcgtggggtctccgtcagcagcgatgtatgccgtggtccgcaggctcgagggagnggccggagtgggcgctaggttattttagagggtggacgactattcgtacggagactccagtgggagggccgtattccaccatcctaccgagtacgtactttttcacgtaacgaactactaccttcgtcttaccttacaaagttcgaaactacgccgtagggacgggaccgaacggacccgacgggtccgttactagtttagttcggtgttgtaggttagtttagtcgggtacgtaggttcgggcgttggggtacggtaacgaggtagtccgcggtcggggtaaccccgg

SEQ ID NO: 44761 - DNA, 685 bp, Homo sapiens
  misc_feature: GYAE6OF01EVKUM.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctacaatttcaggaggtgtccagtgtgaggtgcaactggtggagactgggcggaggcttggtccagcctgggcgtctctgagactgtcctgtgaccctcgtggggtcctccgtcagcagcgactgtattgcctgggtccgcaggctccgagggagaggccggaggtgggtcgcgtagggttattttttagagggttgggacgtactagttacgtaacggagaacgtcccagtcgggacggggtcccgtaattccgaacctacgttcctacccgaggtaacgttacctttttcgtacgtaaacgaacctacgaaccttgtaccttacttacaaaagttcgaaaccgtaggtccgtagggacgggaccggaacgggtaaccgaaccgggtcccttacgttaacgttttacgtttcggttaggttagggtaagttaggttttaagtgggtaccgtaaggtcgggtacgttggggtacgggacaaggtacgttacgaacggtcgggggaaccgaaccgggtaacccgg

SEQ ID NO: 44762 - DNA, 766 bp, Homo sapiens
  misc_feature: GYAE6OF01D5K0W.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgctgcaatttcaggagtgtccagtgtgaggtgcaactgggtggagacgtgggcggaggctttggtccaggccgtggggcgtctcgtggacgacgtcgtcctggtacgaacccttcgtgggtcctccggtcagcagcgtatgtattcggccgttgggtcccgcgaggtccgtaccggaggggaacggcgggccgggtaggtcgggtcgacgtaaggtttacgtttttaggagggttcgggaacgtactacgtttacgtacggtacgtacgtaccggtaagtcgggggacgggtccgtattaccgacccgtaacgtccgtaccgtaaggtacgtttaccgtttttcgaaccgtaaacgtaaccgtaaccgttacgttacgttccttaccgtttaacgaaaacgtcgaaaccgtcgtacccggtagggaccgggtaaccggtaagggtacccggtaccggggttacccgtttagtttaacgtttacggttcggttacggtaacggtaaggtttcggtttaaggtcgggtacgtaggttcgggtccggttagggtacggtaacgtacggtaccgttacggtaccgggttccggggacccgtaaacccgggg

SEQ ID NO: 44763 - DNA, 699 bp, Homo sapiens
  misc_feature: GYAE6OF01DCST1.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagcctgggcggtctctgagactgtcctgtcgaccctcgtgggtctccgtcagcagcgactgtatgccgtgggtccgccaggctccgagggaagacgggccggaggtcgggtcgcgtaggttattttagtagggtggacgacgtagttacgtacggagtacgtccgagtcgggagggccgtattacgacctactcctccgaaggtacgttacctttttcgtaccaacgtaaacctacgtaaccgtcgttaccttctttaactaaaacttacggaaacctacggaccgtacgggaacggggacccggaacgggtaaccgacccggggtacccgttacttaacgttttaacgtttcggttaggttaggtaaacggttaggttttagtcggggtacgtaaggtttcgggtcgtttacggggtacggtaacgtaggtaacttccggaacgggtcccgggggtacccgtaaacccgggg

SEQ ID NO: 44764 - DNA, 694 bp, Homo sapiens
  misc_feature: GYAE6OF01CSTZ9.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggagtgtcagtgtgaggtgcaacgtggtggagacgtgggcggaggcttggtccaggccgtgggcgtctcgtgagactgtcctgtgaaccctcgtcggggtctccgtcagcagcgactgtattgccgtcggtccgccaggctcgagggaaggaggccggaggtgggtcgcgtaggttattttagtaggtgggacgacgtattcgtaacggacgacgtccgagtgggacggccgtagttccgaccactaccctacgagtacgttactttactacgaacgaactactacgtcgttaccgttacttaactaaacgtaacgaacgtaaccgtacggtacggaaccggggtacccggaacgggtacccggtaccgggttacccgttaacgttacgtttaacggttacggttagttacggtaaggttaacggttttacggttagggtacggttaaggttccgggtagggttacgggtacggtaacggtacggttaacgtaccgggtacggggttaaaccccgggggg

SEQ ID NO: 44765 - DNA, 729 bp, Homo sapiens
  misc_feature: GYAE6OF01D9OY5.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctcgtgagactgtcctgtcgaccctcgtggggtcctccgtcagcagcgtactgtattgccgtcgggtccgccgaggccgtccggaaggggaaggacgggccgggaggttgggtcgcgtaggtttatttttagtagggtgggacgacgtagttcgtacggagactccgagtgggacgggccgtattccaacctacgtacctaccgaagtaaccgttactttttccacgtaacgtaaacctacctacgttcgttaccttactttaacaaattcgaaccacgtaccgtagggaacggggcccgaacgggaccgtaccggggtcccgtttacgttaacgtttacgtttaggttaggttacggtaacgggtttaggtttttaacggcggggtacggttaaggttcggggttccggttagggggttacggaaaccgtagggttaacgttacccggaaccgggggttaccggggggaccccgtaaaaccccggggggg

SEQ ID NO: 44766 - DNA, 653 bp, Homo sapiens
  misc_feature: GYAE6OF01B8VJY.19.67.G01.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (484)..(484): a, c, t, g, unknown or other
  misc_feature (484)..(484): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgtggggacatcgtgatcgacccagtacccagactcactggctgtgtctcgtgggcgagaccggccacaatcaactgcaggtccagccagaactattttccnccacctaccaaagaaacctaaaaacttcttacgcctaggtaaccaacgagacgaccaggaccagtcctactaagttcgactctatttacgnggtcttcgtacgcgtacgtacgttccgggcctgaccgtagttcccgggnacgggtcggtcgtagggacagtacttccactctcaccgatcagtcagcctgcgaggctagaagtagtggtacgattaagtttatacgtgtacaagtacttaagtttnttttacctacgtcccgttaccggttggtaacccggtttccggaaccggtaaacggggtaccgtaacggggttaacgaaaacgtaccgtaacgggtaaccggtaacccgttggggtaccggtaccgtacgtaacccgtacccttagtttccttacgggttccctttaccg

SEQ ID NO: 44767 - DNA, 594 bp, Homo sapiens
  misc_feature: GYAE6OF01BR4ZK.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtcgaaccctcgtggggtctccgtcagcagcgactgtattgcctgggtccgccgaggcctccgaggggaagacgggccggaggtgggtcgcgtaggttagtttttagagggtgggacgactattctacggagactcagtcgggagggccgattccgacctatcctccagtacgtacttttctcaagaactaacacttgttcctcttacaaatcgaacagcctggacgggccgaaggacctaacgggccgttactagttacttgtggttaggtagtagttttagcgggtagtagttggggactgggtacgggaacgtaggattccgacgggtgggggtaaccccgg

SEQ ID NO: 44768 - DNA, 878 bp, Homo sapiens
  misc_feature: GYAE6OF01C5QOJ.19.67.G01.1.454.CMB.1.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactgggtggagactgggcggaggtcttggtccagccgtggggcggtctctgagactgtcctgtcgaaccctcgtggggtctccgtcagctagcgactgtatgccgtcgggtccgccaggctcgagggagacggccggaggtgggtcgcgtaggttactttttagagggttacggggacgtaacgtagtttacgtaacgggacgtaaccgttacccgaaggttcggggaacggggtacccgtaacgtttaccgaaaccccgtaagttacccgttacccgaacggttaaccggtttaaccttttttaccgtaccgaaaacggtaaaccctaaccgtaaaccgtttacggttaccctttaacccgtttaacgtaaaaacgttcggaaaacccgttacggtaccccggttaacgggaacggggggaccccggtaaaacggggtaaccccggtaacccgggggttccccgtttaacgtttaaccgtttttaaggtttaccgggttttaagggttagggttaaaaccgggtttaagggttttttaaacgggtcgggggttaacccggttaaggggttcggggttaacccgggtttaggggggttaacggggtaacccggtaaagggttaaccgtttaccgggaaacccggggttacgggggggtacccccggtaaaaccccgggggggg

SEQ ID NO: 44769 - DNA, 767 bp, Homo sapiens
  misc_feature: GYAE6OF01CFJXP.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggtagttttggctgaccgttgggttttccttgctgctaattcgaggtaggtgtccagtggtgaggtgactaacgtggtaggacgacgtgggacggaggtcgttcggtccgaggtccggtggggcggtctcgtgacgtacgtcgtcgtacgtacgaaccctggtcggggttcctccggtacgagccgtacggcgtaacgttggtacgttcggtcccggttcgggtccccgccgtacggtaccgtaccggaaaggggaacgggacgggtaccgggtagggttacggggccgtacggttaagggttttaactttttaggggtaacgggggtacgggtaaccgtaacggttaagttaccggtaaccgggtacgtaaccttaccggagggtacgggacgggtaccgtacttaacccgaccgtactaccgtacgtaaggtaccgttacttttcaacgtaacgaactactacgtcttaccgttaactacgaaacgttacgaacgttcggaccgtacgggaacggtaccggacggaacccgtcggtaccgttagttagttacgtgtagtacggtaggttagttacggtggcgtagtcggtaggtggtacggacgtacgtcgtacggtcggtcgggtaacccggg

SEQ ID NO: 44770 - DNA, 775 bp, Homo sapiens
  misc_feature: GYAE6OF01DN1EU.19.67.G01.1.454.CMB.1.raw
tcagtactctcgtgcacgaccggtgctcgatttagagtatacatattgggttgggggggagaggagcccagcacgtgggattccgaggtgtttccattcggtgcctcagtcactgaacactagaggactcaccatcggacgttttggctgtacctgggtttttcctgctggtctaagtttcgaggaggtgtccagtcgtgaggtgctaacgtgggtggaggtaccgtgggcggaggtcctttggtccaggccgtggggccggttctcgtgtacgaccttgtaccttagtcgaacccgtcgtggggtcctccggtcgacgccagcgacgtggtagttcgccgtgggtccgccaggctaccgaagggaagtcggccggtaggtcgggtcacgtaggttaattttacgtaggtcggacgtacgtacgttacggtaacggactaacttcgagttacggggacgggtaccgtaacgtttaccgaacccgtaacgttccctaaccggtaaacgtacggtttaacctttttcgaactaacggaaacctaacgtaacgtttcggtactaccttaccgaaaagttcggaaaccgccggtaaccgtacgggaccggggtaccggtaacgggtaacccgtaccgggttcgttacgtttaacgtttacggttaggtacgggtaggtaacgttaaggttttacgtacggggtactaaggttcggtccgttaggggtacggaacgtacggtaacgtccggaacgggtcgggggaccctaaacccggggg

SEQ ID NO: 44771 - DNA, 571 bp, Homo sapiens
  misc_feature: GYAE6OF01C04MC.19.67.G01.1.454.CMB.1.raw
  modified_base (412)..(412): a, c, t, g, unknown or other
  misc_feature (412)..(412): n is a, c, g, or t
tcagtactctcgtgcacgaccggtgctcgatttagagtatacatattggggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggaagaggccggagtgggtcgcaggtattttagaggtgggacgacagttctacggagactcagtgggagggccgattcaccatctccagtagtacttttcncagaacactactcgtctcttacaaatcgaacacgcctggacgggccgaaggaccgacgggtccgtacttagttagttgtggtgtagtagtttagtcggtacggagtcggtacgttggtagggacgtaggattacgacggtggggccgtaaacccggggg

SEQ ID NO: 44772 - DNA, 657 bp, Homo sapiens
  misc_feature: GYAE6OF01ASPJP.19.67.G01.1.454.CMB.1.raw
  modified_base (590)..(590): a, c, t, g, unknown or other
  misc_feature (590)..(590): n is a, c, g, or t
tcagtactctcgtgcacgaccggtgctcgatttagagtatacatattgggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcgggaggcttggtccagccgtgggcgtctctgagactggtcctgtcgaaccctcgtggggtctccgtcagcagcgactgtatcgcctgggtcccgccgaggctccgagggaacggacggccggaggtgggcgcgtaggttacttttagagggtacgggacgtacgtacgttacgtacggacgtacgtccgagtcgggacgggaccgtacttccgaaccacgtacctaccgaagtacgttaccgttttacgacgaacgtaaacctactacgtacgttacctacgttaacaaatcgtaactacgtaccgtaggaacgggcccgaagggaccgtacgggtcccgttacttacgttagttgtcgtagtacggttagtttaggnggtacgtagtcgggtcgtaggtacggtactacggtactacggaccggtcggggcccggtaaccgggg

SEQ ID NO: 44773 - DNA, 536 bp, Homo sapiens
  misc_feature: GYAE6OF01BQN95.19.67.G01.1.454.CMB.1.raw
  modified_base (306)..(306): a, c, t, g, unknown or other
  misc_feature (306)..(306): n is a, c, g, or t
  modified_base (444)..(444): a, c, t, g, unknown or other
  misc_feature (444)..(444): n is a, c, g, or t
tcagtactctcgtgcacgaccggtgctcgatttagagtatacatattgggtttggggctgggagaggagcccagcactgggattccgaggtgtttccattcggtgctcagcactgaaccacagaggactcaccatggagttttggctgacctgggttttccttgctgcaatttcaggaggtgtccagtgtgaggtgcaactggtggagactgggcggaggcttggtccagcctgggcggtctctggagactgtcctgtgaaccctctggggtcctccgtcagcagcgactgtattgcctgggtccncaggctcgaggagaggccggagtggtcgcaggtattttagaggtgggacgactattcgtacggagactccagtggaggccattcacgatctccagtagtacttttcacagaacacactgtcttcttacaaatcgaacngcctgacgggtccgaaggaccacggcctactagttagttcgtagtgagtagttcgtgacgtatggctggtgactaggactgcggtaccgggg

SEQ ID NO: 44774 - DNA, 650 bp, Homo sapiens
  misc_feature: GYAE6OF01BWI6W.19.67.G01.1.454.CMB.1.raw
  modified_base (487)..(487): a, c, t, g, unknown or other
  misc_feature (487)..(487): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtgaacccgtcgtggggtctccgtcacgcagcgactgtatcgccgtgggtccgccgaggctccgagggacgacggccggaggtgggtcgcgtaaggttattttacgtaggtgggacgactacgttcgtacggagtacctccagtgggacgggcctattccacctatcctacccgagtacgttacttttcacaacggaacaccgtactgtaccttacgttactaaagtcgaaccngcccgtagggaaccgggccgtaaggggaacccgtacgggtcccgttacgtaacgtttagttggttacggtaggtaacggttaggttttaggtcgggacggttaggttgggtccggttagggtacggtactaagggtacttaccggaacggttacccggggggg

SEQ ID NO: 44775 - DNA, 736 bp, Homo sapiens
  misc_feature: GYAE6OF01CK2CU.19.67.G01.1.454.CMB.1.raw
  modified_base (172)..(172): a, c, t, g, unknown or other
  misc_feature (172)..(172): n is a, c, g, or t
  modified_base (189)..(189): a, c, t, g, unknown or other
  misc_feature (189)..(189): n is a, c, g, or t
tcagtactctcgtgcacgaccggtgctcgatttagagtatacatattgggtttggggggagaggagcccagcactgggattccgaggtgtttccagttcggtgctcagcactgaacacagaggactcaccatggagtttggctgacctggttttcctgctgcaatttcaggngtgtccagtgtgaggtnccacgtggtgagctggcggagcttggtccagccgtgggcgtctcgtgagtactgtcctggtcgaacctcgtgggtctccgtcagtcacgcgactgtacttgccgtgggtccgccaggtctccgagggaacgaggccggagtgggtcgcgtaggttattttagagggtggacgactagttcgacggagccgtccgagtcgggacgggtccgtagttcccaccgtatccctaccgaagtacggttacctttttccaccgaacggaaacctaccgtaacgtttcggttacccttaccgtttaaccgtaaaacgttacggtaaacccgtacggtaccccggttacgggaaccgggggaccccggtaacggggaacccgtacccggggtacccgtttaaccgtttaagttttaacggtttcggttacggttacgggtaaggttaacggtttttacggcgggtaccgtaggttcgggtcggttacggggtaaccggtaccgtaggtaccgttacccggtaaccgggtcgggggtaaccccgtaaacccggggg

SEQ ID NO: 44776 - DNA, 673 bp, Homo sapiens
  misc_feature: GYAE6OF01DU2UH.19.67.G01.1.454.CMB.1.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (496)..(496): a, c, t, g, unknown or other
  misc_feature (496)..(496): n is a, c, g, or t
  modified_base (543)..(543): a, c, t, g, unknown or other
  misc_feature (543)..(543): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctggttttccttgctgctaatttcaggagtgtccagtgtgaggtgcaacgtggtggagacgtggcggaggtcttgggtccaggccgtcgggtcgtctacgtgacgtntcgtccgtgtaccgacccgttcggtcgggtcctccgtnacgcacgcgtacgtgtagttcgccgtcgggtcccgacgacggccgtacggaagggaacgaacgggccggtaggtcgggtcgtacgtaggttttaagttttaggtagggtacggaccgtaagtacgtttacgacggtactaccgtccgtagtacgggaggtcccgtaattcccgaagtctaccgtaccaagtcgtttacctttnaacgtaacaactacctagttcgtacttaccttaacaaactacgaacncgtaccgtagggaccggaccgaggtaccgccggttcctattaagttacgttgtagtacggtaagttaacgtttgacggtcgtggtacgggtcgtggtaacggacgtaagacttccgggaaggtcccgggg

SEQ ID NO: 44777 - DNA, 603 bp, Homo sapiens
  misc_feature: GYAE6OF01AONUE.19.67.G01.1.454.CMB.1.raw
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
  modified_base (436)..(436): a, c, t, g, unknown or other
  misc_feature (436)..(436): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagacggccacaatcaactgcaggtccagccagaactattttccnccacctaccaaacgaaactaaaacttctacgccgtaggtaaccaacagacgaccgaggacacgcctactaagtnctctatttacgcggtcttcgacgcgtacgtacgttccgggcctcgaccgtgtccggggcacggcggtcgtgggactagtacttcactcacacgatcagcacgctgcgagtctagaagngtggtgacttagtttatacgtcgctaagtacttaagtttctttttacgtaccttccggttcggttacggtaccgttccgggaccgtaacggggtaccggtaggggtaacgtaaacgtacgaacggtaacgtacggtggtcgcgtacgaaccctacgtgttcgttacg

SEQ ID NO: 44778 - DNA, 779 bp, Homo sapiens
  misc_feature: GYAE6OF01A1GYO.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagacgtgggcggaggcttggtccagccgtggggcgtctctgagactgtcctgtgaaccctcgtcggggtctccgtcagcagcgactgtatgcctgggccgccgaggctccgaaggggagacggccggaggtgggtcgcgtaggttagttttagtagggtgggacgtactagtttcgaacggagaccttccgagtcggggacgggtcccgtaacgttccacccagttcctaccgaaggtacgttacctttttacgtacgaacggtaaacctacgtaccgtttacgtcccgttaacctttacaaaacgtttacggaaaccctacggtacccggttacgggaaccggggggtcccggaaaccggggtaacccgaacccggggttaccccggttaccgtttaaagttttaaccggtttgggtttacggggtacggttaaacgggtttacgggttttaacggttacgggggtccggttaaaggttccgggggtcgtttaacgggggtacgggtaaacgacggttaacggttacccggaaccggggtttcccgggggggaaccccgttaaaaccccggggggg

SEQ ID NO: 44779 - DNA, 952 bp, Homo sapiens
  misc_feature: GYAE6OF01DY6RG.19.67.G01.1.454.CMB.1.raw
  modified_base (943)..(943): a, c, t, g, unknown or other
  misc_feature (943)..(943): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctcgtggggcgaggaccggccaacaataccaactgaccgtacggtaccacgaccaagtaacttactttttccctacccaacccgtaaccaaaaacgtaaaacctaaaaaaccgttttccgttaacgtcccgttaacgggttaaaacccaaaacgaaaggaaaccggaacccgaaacggggaacccgtaaccggtacccctttaacccgttaaaagggtttcggtaccctttaccgttaaacgttttttacggtcgggggttaccctttttaccgtaaacccgggtccgggtaaccggttaaaaccgggttttccccggggggttaccccctaccggggtaaccccggttaccggggtttccccggggggaacgtacgggggttcccgggggtttaccggttaacggggggtaaacccttaacggggttaaaccttttttacccgaaacccgtttacccggttaacccctaaacccgtaacgttaacccgaaccgggtccctaaccgggtcccgttaccgggaccgtacgggtaccgtaaggaaaaccggttggtcggttacgggtaccttttaaggttttaacgttaccgttgttaccaacggttaactttaacgttttactttttttaccgttaccgttcccggttcgggttacgggttaccgggtttaccggaacccgggtaaagggtacccgtaagggggtaacgtaactaggtaacggaaccggtacgtgggtaccgtctacgaccctacctnttcgttacg

SEQ ID NO: 44780 - DNA, 678 bp, Homo sapiens
  misc_feature: GYAE6OF01DWRZW.19.67.G01.1.454.CMB.1.raw
  modified_base (178)..(178): a, c, t, g, unknown or other
  misc_feature (178)..(178): n is a, c, g, or t
tcagtactctcgtgcacgaccggtgctcgatttagagtatacatattggggtttggggggggagaggagcccagcactgggattccgaggtgtttccattcggtgctcagcactgaacacagaggactcaccatggtagttttggctgaccttgggttttcctgctgcaatttcaggnggtgtccagtgtgaggtgcaacgtgggtggagacgtgggcggaggcttgggtccaggccgtgggcgtctctgagtactgtcctggtcgaacccgtcgtggggtctccgtcagcagcgacgtgtattcgccgtcgggtcccgccgaggtccgtccggaaggggaaggacgggccgggaggttcggggtcgacgtaggttaagtttttaggagggtggggacgtactattcgtacggagtactccgagtcgggacgggccgtattaccacctactccgtaccaggtacttacctttttcacaacgaaccaactacttcgtccttactttaacaaactagaaccacggtacccgtagggaaccgggccggaacgggtaaccgacccgggtaccgttcgttaagtttagttgttggtagtaggttagtttaggacggtcgaggttcgggtcgttagggtcggaactaggtactaggtaccggtgggggcccgtaaacccggggg

SEQ ID NO: 44781 - DNA, 574 bp, Homo sapiens
  misc_feature: GYAE6OF01CT3VC.19.67.G01.1.454.CMB.1.raw
  modified_base (403)..(403): a, c, t, g, unknown or other
  misc_feature (403)..(403): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
tcagtactctcgtgcacgaccggtgctcgatttagagtatacatattgggtttgggggggagaggagcccagcactgggattccgaggtgttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctcgtgggtctccgtcagcagcgactgtattgcctgggtccgccaggctccgagggagaggccggaggtgggtcgcaggttatttttagaggtgggacgactagttcgtacggagacgtccagtggagggccgattccaccactcnccagagtccttttacgcaacgaactacaactgtcctcttacaaatgaaccngccctgacgggccgaaggaccgacggtccgttntagtttattgcgttgacgtagttttacgtgggctagtgggtcttggggtagaccagggtatccacgggtcggggcccgtaaccgggg

SEQ ID NO: 44782 - DNA, 899 bp, Homo sapiens
  misc_feature: GYAE6OF01BOCDQ.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggtagttttggctgaccttgggttttcctgctgctaatttcaggaggtgtcagtgtgaggtgcaacgtggtggagacgtgggcggagtcgttggtccagccgtgggcggtctcgtgagctcgtcctgtcgacctcgtcgggtctccgtcagcagcgtacgtgtagttcggccgtcgggtccgaccgacggccgtaccggaaggggaacgacgggccgggaggttcggggtccgtacgttaaggtttaacgtttttaggacggggtacgggtaacgtacgttaacgtttacggtaacgggaacgtaccgttacccggtaaggggttacggggggaaccggggtaccccttaaacggtttacccgaaaaccccgttacggtttaccccgttaacccggaacggtttaaaccggtttaaccctttttttaccgaaccgtaaaacgggtaaaaccctaccgttaaaccgttttccggttaccctttaactttaaaccgtaaacgttaacggaaaccgtaacgggtacccggttaaccggggaacggggtaacccgggaaacgggtaacccgggtaacccgggttcccgtttaaccgtttaagttttaacgggtttacgggttagggttaaccggttaaaaggggtttggttttaaagggccggggttaaggacgggttttacggggacggtttacgggggtaaccggtaacggtaacggtacggttaaccccgggtacggggttacccggggggacccgttaaaccccggggg

SEQ ID NO: 44783 - DNA, 879 bp, Homo sapiens
  misc_feature: GYAE6OF01DP2XH.19.67.G01.1.454.CMB.1.raw
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggttttccttgctgctaatttcgaggtaggtgtccagtgtggaggtgctaacgtggtggagcgtgggcggagtcgttcggtcgagtcccgtgggcgtctcgtggagtacgttgtccgtgtcgaacccgttcggtgggtcctccgtcgacgcagcgtaccgtagtnttcggccgtcgggtcccncgacggcctccggagggaaggacggcgggtaggtcgggtcgacgtaggttaactttaggtagggtacgggtaacgtaacgtagttaccggtaacggacgtaccgtacgaagtcgggtaacggggtaccctagtttacccgaacccttacgtacccgttaaccgaacggtacgtttacgtttttacccgacgtaaacggtaaccctaacgtaaccgttcgttaaccgttaccttaaaccgtaaacgttaaccggtaaacctacggtaacccgggttagggaaacccgggggtacccggtaaacccggggtaacccggtaaacccgggttaaccccgttaacgtttaaccgtttaacggtttcgggtttaaccggttaacgggttaaacgggttttaaccggtttttaaaccgggtacgggttaacccggggttacgggtttaacccggggttaacgggttttaccgggggtaacggggtaaaccggttaaaaccggggtttaaccgtaacccccgggggttaaacggggttaaccccccggggggg

SEQ ID NO: 44784 - DNA, 675 bp, Homo sapiens
  misc_feature: GYAE6OF01COOEN.19.67.G01.1.454.CMB.1.raw
  modified_base (495)..(495): a, c, t, g, unknown or other
  misc_feature (495)..(495): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgcaatttcaggagtgtccagtgtgaggtgcaacgtggtggagacgtgggcggaggcttggccaggccgtggggcgttctacgtggaacgtctcggtcctggtacgaaccctcgtcgggtcctcgtcagcagcgtactgtagttcgccgtcgggtccgcgacggcctccgagggaacggcgggccggaggtcgggcgcgtaggttagttttagagggtcggacgatacgttcgtaggacacgtcgagtcgggacggcgtattacactactcctaccagtacgtacttttcacgtaacgaacactaacttcgtacttactaacaaagtcgaacncgtcgtagggacgggtccgaaggaccgtaccgggtaccttaccgttaagttacgttcggttacggtagttaaggtaggttttactacgggggtacgtaagggttgggtccgttaggggttaccggaacgtacggaaccgtttaggaacccggggttcgggggccccgtaaaaccgggggg

SEQ ID NO: 44785 - DNA, 581 bp, Homo sapiens
  misc_feature: GYAE6OF01AGW8P.19.67.G01.1.454.CMB.1.raw
  modified_base (428)..(428): a, c, t, g, unknown or other
  misc_feature (428)..(428): n is a, c, g, or t
  modified_base (464)..(464): a, c, t, g, unknown or other
  misc_feature (464)..(464): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctggggtctccgtcagcagcgactgtattgcctgggtccgccaggctccgaggggagagggccggaggtgggtcgcgtaggttatttttagagggtggggacgacattcgtacggagactccagtgggagggccgtattcaccatcctccgagacgtacttttccncaagaaccacaccttgtcctcttacaaattcgaacngcctaggacgggccgacggaccgacggtccgtcttagttattgtgtgaggtagtttagnggtcgtagtgggtcgttgggtaggacgtaggactacgacggtggggcccgtaacgggg

SEQ ID NO: 44786 - DNA, 779 bp, Homo sapiens
  misc_feature: GYAE6OF01D8MCG.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggagttttggctgaccttgggttttccttgctgctaatttcgaggaggtgtccagtgtgaggtgcaacgtggtggagacgtgggcggaggtcgttcggtccagccgtggggccgtctcgtgagactcgtcctgtcgaccctcgtcgggtctccgtcagcagcgactgtacgtcgccgtcggtccgccgaggcctaccggaggggaacgacgggaccgggtaggtcgggtacgtacgtaaggtttagtttttaggaggggtcggaaccgtacgtacgttacgtaacgggtacgtaaccgtccgaaggtcggggacgggtacccgtacgtttaccgaacccgtacgttcccgtacccgaacggttaacggtttaccttttacccgtactaaaccgtaaacctacctaccgttcgttacccgttaccttaacgtaaaacgttcgaaaccgtaccggtaccgtaggggaaccgggacccggtaacgggtaacccgtacccgggtaccccgtttagtttaacgtttacgtttggttacgggttaggtaacgggtttaagttttacggttacggtagggttacggtcgggttcggttaggggtacggtaacgtaggtacgttaccggtaccgggtccgggggtaaacccccggg

SEQ ID NO: 44787 - DNA, 847 bp, Homo sapiens
  misc_feature: GYAE6OF01BUUYC.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggagtgtccagtgtgaggtgctaacgtggtggagacgtgggcggaggcttggtccaggccgtgggcggtctcgtagagtactgtcctggtaccgaacccgttcgtgggtcctccgtcagcagcgactgtacttcgccgtcgggtccgccgacggccgtccggaaggggaacggacgggccgggaggtgggtccggtacgtaggtttaagtttttaaggtagggttaggggacgtaacgtacgtttaccgtaacgggtacgtaaccgtccgtaaggtacggggaacgggtaccggtacgttacccaacccgtaacgttacccgttaccgtaaacggtaacgtttaccgttttactaccgtaaacgtaaaccgtaacctaaccgttcggttacctttacgtttaaacctaaaagttaaccggtaaaccgtaacggtacccggtaagggtaacccgggggtacccggtaaaccggggtacccggtaaccggggtaaccccgtttacgtttaaacgtttaaggtttacggttacggttacggttaaacgggttaggttttaaaggtcgggtaacgggttaaggttccggggttaccggttaggggtaccggtaaaccgtaacgggttacgttaacccggtacggggttaaccggggtccccggttaaaacccgggggg

SEQ ID NO: 44788 - DNA, 659 bp, Homo sapiens
  misc_feature: GYAE6OF01CSBH0.19.67.G01.1.454.CMB.1.raw
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcttggtccagccgtgggcggtctcngagactgtcctgtcgaacctcgtcggggtctccgtcagcagcgactgtattgccgtgggtccgccgnggccgtccgagggaacgagggccggaggtgggtcgcgtaggttagttaggttaggaattaggtgacgtaggtatacgcctagtcggcggactcgtggtaggaacgggtaccgtacttccacctactccgtaccaaggaacgaacaaccgtaccaaacggtaacccttcccgtacgttactaccgtagaacaaagttacgaactaacggtactggaacggtgaccgttgaacgggtaccgaccggttccgtttgttaacgtttactaggtcggtaggtaacgggtaagggtaacttacgggacgtacggtaactttaggttacgggttaacggtacgttaaacccggggg

SEQ ID NO: 44789 - DNA, 787 bp, Homo sapiens
  misc_feature: GYAE6OF01B8AD7.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctggttttccttgctgcaatttcaggaggtgtccagtgtgaggtgtacgtagtggaggacgaggtcggcggacgtcgttcgacgacgtcggtcggtcgtcgtgtagacgtcgtcgtcgtgtaccgtaccgttcgggttcggtccgtccgtagacgacgacgacgtacgttagttacgtcgtcggtcggtcccgcgacgtccgacggaagggaggccggcggtaggtcggtcgaggttacgttttagtttaggtacgggtacggtaacctagttacgttacggaacggtacgtaccgtacgtagggtacgggaccggtacgtacttacccgaacttaccgttacccgtacggtaacgttaaccgttttactttccgaaacgaacgtaaacctcgttacgttacctttccttaacgtaactaagtaccgaaacgtaccgtcggtaacggggaccgggtaacccggaacgtaacccgggttaccggtaaccctttaggttaagttttaccggttgggttaaggttacgtaaacgggtttttagttgggaacgggtacgtttaggggtaccggttcggggttaaggggttaaccgaacggttaacggtccggtaaacccggttcggggggtaaaccccgggg

SEQ ID NO: 44790 - DNA, 610 bp, Homo sapiens
  misc_feature: GYAE6OF01CGDT2.19.67.G01.1.454.CMB.1.raw
  modified_base (441)..(441): a, c, t, g, unknown or other
  misc_feature (441)..(441): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccgccgaggctccgaggggaagaggccggaggtgggtcgcgtaggttatttttagagggtgggacgacagttctaacgggagtacctccaagttggggagggcccgaatttccaccgactcctaccagacgtacctttttcnccgaagaaaccacaactcgtcttcttacaaatgaacacgccgtaggacgggccgaaggacacgggtccttagtatttagttgtgtagagtagtttagtgggcgtagtcgggtcgttgggtacgggactaggactaccggtacggttcgggggacccgtaaacccggggg

SEQ ID NO: 44791 - DNA, 812 bp, Homo sapiens
  misc_feature: GYAE6OF01B2574.19.67.G01.1.454.CMB.1.raw
tcagtactctcgtgcacgaccggtgctcgatttagagtatacatattggggtttgggggggagaggagcccagcactgggattccgaggttgtttccattcggtgctcagcactgaacacagaggactcacatggagtttggctgtaccttgggttttcctgctgactaatttcgaggaggttcgtccaggttggtggagggtacgaccgtaaacggttggggtgggaacggtacgtggggccgggagggtccttcgggtcccaggtcccgtggggtccggtctcgtaggacgtctcggttccctggtaccgtaacccgtcggtcgggtccgtccgtacgagacgacggcgtacgtgttacgttcggtccggttcggggttcccggaccgacggttccgaccggaagggaaggaacgggcgggaagggttcgggtcggacgttaggtttaagttttaggtagggtacgggtaacgtaactacgttacgtaacggacgtaccgtaccgtaggtacgggacgggtaccgtacttaccgaaccgtacgtcctaccgtaagtacgttaccttttactacgtaaacgtaacctacgtaacgttagttacctacgttaacgaaacgtacgaaccgtacggacgtacggggaacgggaccggtaacggtaacccggaccgggtaccgttacgttaactttacggttgttacggtaggtaaggtttaggttacggttacggtcggtaagggtcggtacggtaggtaccggaggtacggtacgttaacggaccggttcgggggaccccggtaaacccgggg

SEQ ID NO: 44792 - DNA, 773 bp, Homo sapiens
  misc_feature: GYAE6OF01CDOVB.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcgggaggtcgttgggtccaggccgttggggccggttcctcgtaggacgtaccttggttcccgttggtacgaaccccgttcggttcgggggttccttccggtcaacggccaggcgtacgttggttacttcggcccgttcggggtccccgccgacggtccgtaccggaagggggaacggacggggccgggtagggttcggggtcgtcgtaaggtttagttttttaggaggggttaggggaacgtactacgtttacggacgggacgtacgtaccgtaggtcggggacgggccgtagttcccgacctactccgtaccaggtacgtttaccgttttaccacgtaacgtaacctacctacgtcgttccttacttacgaaactcggaaacctacggtaccgtaggggaccgggtcccggaagggaacccggtaccgggttaccgttacgtttaatttacggtttggttacggttaggtacggtttagttaggtcgggtacgtaggtcgggtcgttggggtacgacgtagtacgtaccgtcgggtcggggtacccgtaaccggggg

SEQ ID NO: 44793 - DNA, 609 bp, Homo sapiens
  misc_feature: GYAE6OF01D9Y2J.19.67.G01.1.454.CMB.1.raw
  modified_base (478)..(478): a, c, t, g, unknown or other
  misc_feature (478)..(478): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgaccttgggttttccttgctgcaatttcaggaggtgtccagtgtgaggtgcactggtggagactggcggaggcttggtccagcctgggcggtctctgagactgtcctgtcgaaccctcgtggggtctccgtcagcagcgacgttgtattcgccgtgggtccgccgaggcctccgaggggaacgcgggccggaggtcgggtacgctagggttatttttagagggtggacgtacgtagttcgtacggagactccgagtgggagggtccgaattccaaccatctaccgagacgtacttttcacacgtaacacacttcgtcttcttacaaagttgaacngtccgtagggacgggtaccgaaggaccgtaccgggtccttattattacttggtgtaggtagtagttttagcgggtacgaggttcgggcgttgggtacggtaccgagaccgttcgacggtcggggaacccgg

SEQ ID NO: 44794 - DNA, 680 bp, Homo sapiens
  misc_feature: GYAE6OF01EQDJZ.19.67.G01.1.454.CMB.1.raw
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
  modified_base (667)..(667): a, c, t, g, unknown or other
  misc_feature (667)..(667): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatgacccagtacccagactcactggctgtgtctcgtgggcgagaccggccacaatcaactgcaggtccagccaagactctttccnccacctacaaagaaactaaaacttctacgcctacggaaccaacagacgaccagacacgcctacgtaagtcnctctactttacgtggtccttacgacgcgacgtaacggttccgggtcccnggtacccgtcggttcccgggnacgggtcggtcgtggactagtcttccactctaccacctagtacgacgtcgaccgtccngccaaggtcctaggaagacgttcgtaggtaccgtttagttttacgttacttggactaacgtacgtttaaacttttcgtttttacctttaccgttcccggttaccgggttacggttaaccgggttcccgggaaccggtaaacgggggtaccgtaaggggttaccgtaaaacgtccgaacgggtaaaccggtaacgttgggaccggtaccgacctaacccgtaccgtnttcccgtttaccg

SEQ ID NO: 44795 - DNA, 709 bp, Homo sapiens
  misc_feature: GYAE6OF01C3QED.19.67.G01.1.454.CMB.1.raw
  modified_base (634)..(634): a, c, t, g, unknown or other
  misc_feature (634)..(634): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatgggtagttttggctgaccttgggtttttccttgcttgctaatttcgaggaggtgtccagtgtgaggtgcaagtggtggagacgtggcggaggtcgttggtccagtccgtggggccgtctcgtggacgtctcgtccgtgtccgaaccgtcgtcgggtcctccgtcagcacgcgacgtgtatcggccgtcgggtcccgccgacggccgtacgaggggaaggacgggcggtaggtcgggtcgacggttaggttagttttaggtaggggtcggtacgtactaacgttcggtaacggacgtaccgtcgaggtcggggtacgggtaccgtattaccgaacctacgttccgaccgtaggtaacgttaccttttcaacgtaacgaacctacctacgttcgttaccttacttaacgtaaactcgaaacgtcgtacccgtaggggacccggaccggtaacgggaccgtccggtaccgtatttacgttagttggtgtagtaggttagtttagnggtacggtagttcgggtcgttaggggtagtacgtacgacgttccgaacggggtccggggtaacgtaaacccgggg

SEQ ID NO: 44796 - DNA, 770 bp, Homo sapiens
  misc_feature: GYAE6OF01ENIGI.19.67.G01.1.454.CMB.1.raw
  modified_base (414)..(414): a, c, t, g, unknown or other
  misc_feature (414)..(414): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctcgtggttcctggcggggacatcgtgatcgacccacgtacccagcctcactggctgtgtctcgtgggcgaggaccggaccaacaataccaacgtcgacgacggtcccaacgccaagtaaaccttactttttcccctaccccaaacccttaacccgaaaacgaaaaaccttaaaaaaccctttaccgttaaccgtacccgttaaccggtaaacccaaaccgaacgaacggaacccgaacggaaccaaccgtaccctaccgttaaacgttcgtcttacttacgnttttaccgtacgggtccttccgtacgtccggaccgtaaggttcccggggtccctacgggacccgtaggttcccgggggctacggggtccgggttacgagggtacagtacttttccgaaccttctaccaaccactccgaacgccacgcccgtagaccgtaaggctaaggaacgagtgttacgacttagtttacttacgtcgtactacgttacttaatttacctttttacttacgttcccgttaccggtacgggtaaccggtttccggaccggtaaacggggaacccgtaggggtcgaaaacgtacgtaacggtacgaacgttcggtacggtactacggtaccctaacgtcgttaccg

SEQ ID NO: 44797 - DNA, 832 bp, Homo sapiens
  misc_feature: GYAE6OF01C8S0E.19.67.G01.1.454.CMB.1.raw
  modified_base (282)..(283): a, c, t, g, unknown or other
  misc_feature (282)..(283): n is a, c, g, or t
tcagtactctcgtgcacgaccggtgctcgatttagagtatacatattggggtttgggtggggagaggagcccagcaactgggattccgaggtgtttccgattcggtgctcagcactgaacacagaggactcacctatggtagttttggcctggtacccttggggttttccttcgcctaggacctaattttccgagggtaggttacgtcctaggtggtggaggtcgacgaacgtgggtggagacggtgggcgggaggtcttggccaggccgtgggcgtctcgnngactgtcgtgtacgacctcggtggtcctcgtcagcagcgtacgtgtatcgcgtcggccgtcgacggccgtacggaagggacggcgggtaccggtaggttcgggaccggtacgtaaggtttagttttaaggacggggttacggtacgtaacgttagttaccgtacggtaacgtaccgtacgtaacgggtaggacccggggtacttaacgtcccgtaaccgtactacccgttacccgtaaggttaacgtttaaccttttaccgtaaccgtaaaccggtaaacctaaccgttaccgttacggtttaacctttaccgttaaaccgtaaagtccgtaaaacccggtacggaacccgtttaggggtacccgggacccggtaacggaaacccgggtcggttacccgttaacgtttagtttacggtcggtttaacggtggttaaacgggttagtttaacgggtcggttacgggttaaggtccggggttaggtaaccgggttacggaaacgtaaaccggtccgttaaccgggacgggtttacccggggggaaacccgg

SEQ ID NO: 44798 - DNA, 589 bp, Homo sapiens
  misc_feature: GYAE6OF01EWXG3.19.67.G01.1.454.CMB.1.raw
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
  modified_base (552)..(552): a, c, t, g, unknown or other
  misc_feature (552)..(552): n is a, c, g, or t
  modified_base (583)..(583): a, c, t, g, unknown or other
  misc_feature (583)..(583): n is a, c, g, or t
  modified_base (586)..(588): a, c, t, g, unknown or other
  misc_feature (586)..(588): n is a, c, g, or t
tcagtactctcgtgcacgaccggtgctcgatttagagtatacatattgggcttggtccagcctgggcggtctctgagactgtcctgtgaaccctctgggtctccgtcagcagcgactgtattgcctgggtccgccaggctccagggaagaggccggagtggggtcgctaggttatttttagtagggtgggacgactatttctacggagactccagtgggagggccgattcacatctccagagtacttttcncagaacacactgtctcttacaaatgaacagcctggacgggccgaggacnccggcctactattntgtgtgagtagtttagnggcgagtggcgtgggtacggacagtatcgacggtcggggaccacggggaccctggtccaccgtctcctaccgcgtccctccgaaccgacgggccctagtcccggttccctccccgcggcccncccgtcgcctaccgaggacnccgtaccgtccgagaccgcaccgcgccggcccgtgggcctcgccgtcgtacgacgtacctaccgtccgagcgacgtcgnggacggcgggtcgtacggacgacgtcgacanagnnng

SEQ ID NO: 44799 - DNA, 877 bp, Homo sapiens
  misc_feature: GYAE6OF01EMELQ.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatcaactgcacggtccagaccaagtaacttacttttccacccaacctaaccaaaagtaaaacctaaaaaacctttcttaacgtacccttaacggtaaacccaaacgaacggaacgaaccgaacggaacctaacgtaccccttaccgttaaaggttcgtaccttacttaacgttttacgtcggggtacctttaccgtaccggaccgtacggttaaaccggtttcccgggggtacccttaccgggtaacccggtacgggttacccgggggacgtaccggggtccggggttaccgtaacggggtaaccctaaggtttaccttttaccgaacccgtttccttacccgaacccgtaacgtaccgaacgtacccgtacgtccccgttaggaccggtacgggtacgtaacggaaggttacgttcgggtacgttacgtttaacgtttttacgttacgtagttaacgacgtaacttttaaattttacgttttttacccgtaccgtttccccggttaccgggtttacgggtaacccgggttccgggaaacccgggtaacggggtaacccgggtaaggggttaaacggtaaacgttacccgggtaaacggaaccggttaaccggttaggttcggtaaccgttacggaacccttaacccgttacttccggttacccg

SEQ ID NO: 44800 - DNA, 730 bp, Homo sapiens
  misc_feature: GYAE6OF01ETJEL.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtgggtggagacgtgggcgggaggtcgttcggtccaggccgtggggccggtctcgtggagctgtcctgtcgacccgtcgtcgggtctccgtcagcacgcgacgtgttagttcgccgttcggggtccccgccgacggccgtacccggaaggggaacggacgggccgggaggttcggggtcgacgttaaggttttacgtttttaaggtacggggttagggaacgtacgtaacgtttcgtaacggtacgtaccgtaccgtaggtggggacggggacccgtaattccaaccgtactccttaccgaagtacgttaccttttcgtacaacgaaccgaactacgtcgttccttacgtaacaaagtcgaaactacgtccgtaggacgggaccggaacggaccgtacccgggccgtttacgttaagtttagttggttacggtagtaggttacgtttaggcgggtacgtagggtcggtcggttaggggtacggaacgtcggtacgttacgacgggtcccggggtaaccggtaaaccccgggg

SEQ ID NO: 44801 - DNA, 775 bp, Homo sapiens
  misc_feature: GYAE6OF01CUCCB.19.67.G01.1.454.CMB.1.raw
  modified_base (179)..(179): a, c, t, g, unknown or other
  misc_feature (179)..(179): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgaccttgggttttcctgctgcaatttcgaggaggtntccgagtgtgaggtgacaacgtgggtggagacgtgggcgggagtctttcggaccaggcccgttgggggccggttcctacgtggaacgaccttggtccctaggttccgaaaccccgttgtcgggggttcctcccggtcaggccaggacgtaccgttagttaacttcggccccgttggggtcccccggacccgaagggtcccttacccggaaggggaaaacgcggggcccgggtaaggtcggggttcggacgtacgggtttaatttttaggaagggttcgggaacggtaacctagtttaccgtaaccggagtaaccgtccgtaaggttcggggacgggtaccggaacttttaccgaaccgtaacgtcccttaccgaaacggtacgttaaccttttcgtacgaacgtaaaccaactaacgtccgttactacctttaaacgaaacgttaagaaacccgtagacccgttagggacgggaccggaacgggaccgaacgggtcccttagttaattagtttgagttggtagttaacgttgtagggtactagtggtccgttaggcgtaacgacgtacgtacgacggtcgggtacccgtaaacggg

SEQ ID NO: 44802 - DNA, 813 bp, Homo sapiens
  misc_feature: GYAE6OF01C5JTW.19.67.G01.1.454.CMB.1.raw
  modified_base (238)..(238): a, c, t, g, unknown or other
  misc_feature (238)..(238): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatcgacccagtacccagactcactggctgtgtctcgtgggcgagcggccacaatcaactgcaggtccagccagactatttcnccactacaagaactaaaacttctagcctacggtaaccaacagacgaaccagacacgcctacctaagttcgactactatttacgcggtcttacgtacgtcgtacgtaaggttcccgggtaccttacggaccgtacggttccggggacgtacggcggggttcgtaggggacctagtacgtttccacgttacctacgacccaagttccaacggccctaacgggtccccttacgggaccccgtaagggtccttaaacgggaaagttacgttaacgggtcggggaaccgttttaaggtttttaacctttacggttaccggtttacgaacgggtttaacttaaaactttttcgttttttttaacccgtaacccgtttcccgtttacccggggttacggttaaccccgggtttaccgggaaacccggttaaacggggggaccccgttaaaggggggttaaaccggggttaaaacttaacccgggaaacgggggtttaaacccgaaccggggttttagggtaacccgggtacttaaacccggggtaccctttaaaccccggtcgttttaacccggtttcccgg

SEQ ID NO: 44803 - DNA, 644 bp, Homo sapiens
  misc_feature: GYAE6OF01EZ1EE.19.67.G01.1.454.CMB.1.raw
  modified_base (244)..(244): a, c, t, g, unknown or other
  misc_feature (244)..(244): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagaccggccaacaatcaactgcaggtccagccaagaactattttccnccacctaccaaagaaactaaaaacttctacgcctacggtaaccaacagaacgaaccgaggaaccacgtccctacctaagttcgctactatttacgtgggtcttcacggcgacgtaacgttccggggtccctggaccgtagttccggggcnggcgggtcgngggacagtactttcacctctccaccatccagccacgtcctggcgaggctaggaagagtcggtggtacttagttttatagttacgtacaaacgttaatttaattaacttacgtttaccgttcggtaggttaccgttaccgggaaccgaaacggggtaccgtaaagggtagtaagtaacgtacgaacggtaaccgtaacgttcgggtacggtccgttacgaccctaactacgttcgttacgg

SEQ ID NO: 44804 - DNA, 543 bp, Homo sapiens
  misc_feature: GYAE6OF01E3GL4.19.67.G01.1.454.CMB.1.raw
  modified_base (457)..(457): a, c, t, g, unknown or other
  misc_feature (457)..(457): n is a, c, g, or t
  modified_base (490)..(490): a, c, t, g, unknown or other
  misc_feature (490)..(490): n is a, c, g, or t
  modified_base (511)..(511): a, c, t, g, unknown or other
  misc_feature (511)..(511): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactgggcggaggcttggtccagcctggggcggtctctgagactgtcctgtgaaccctctggggtcctccgtcagcagcgactgtattgcctgggtccgccaggctccgagggaagaggccgggagtgggtcgcaggtatttttagtaggtggggacgacgattctacggagactccagtggagggccattcacctatctaccagtacgactttttctacagaacacactgtctcttacaaatcgaaacngaccgtgagggccgagacgaccgccgtctattnttgtgtgagtagtttagtggngagtggcttggtggacagactcgacgtcgggg

SEQ ID NO: 44805 - DNA, 784 bp, Homo sapiens
  misc_feature: GYAE6OF01DVUUC.19.67.G01.1.454.CMB.1.raw
  modified_base (236)..(236): a, c, t, g, unknown or other
  misc_feature (236)..(236): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatcgacccagtacccagactcactggctgtgtctcgtggcgagaccggccacaatcaactgcacggtccagccagaactntttccaccacctacaaagaaacctaaaaacttcttacgcctacggtaaccaacaagaacgaccgaaggaccacgacccttacctaaggttcgaccttctaacgttttaccgcgggttacctttacgtacccggacggacgtaaaccggtttccggggtacccctaggtaacccggtcggttcccggggcgacgggtccgggtacgtaggggaacctagttacgtttacccgaccttacgtaccctaaccgtaattccgaaaggtcccaacggtcccgttggaaccggtaggacttaaggaaggtacgttgggttcgggtaactttaagtttttaacgttcgttaaccgtaccgtaagttaactttaagtttttacgttttttaccttaaccgttccccgttacgggttccggtaccgggtttccggaaacccgggtaaacgggaccgtaaggggttaacgtaaacgttaccgggaacggtaacccgtaaaggtttccgggacggttacccgtacgtaaccccgttaacctcgttttaccggttaaccg

SEQ ID NO: 44806 - DNA, 741 bp, Homo sapiens
  misc_feature: GYAE6OF01DQGZ2.19.67.G01.1.454.CMB.1.raw
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgcctgcaatttcgaggaggtgtccagtgtgaggtgcaactggtggagactgggcggagcttggtcccagcctggggcggtctcgtgagacttgtcctgtcgaaccctcgtggggtctccgtcagcagcgactgtattgccgtgggtccgccgaggctccgagggaagaggccggnggtagggtcgcgtaggttatttttagagggtgggacgtanatttacgtacggagtactccgaaggtgggacgggtccgtagttcccaactactcctacctaaggtacgtttacctttttacacaacggtaaacctaactacgtcgtttcttacctttaaccgtaaaattacggaactaacgtacccgttacggggaacggggacccggaacgggaccggtaccccggggtacccgttttaccgttaacgtttttaaggtttggtacgggtttaggaaacggtttagggttttaagtcgggggtacggttaagggttccggggttggtaacgggggtttacggaaaccgttaggttaacggttacccggtaaaccgggtcggggggtaacccccgtaaacccgggggg

SEQ ID NO: 44807 - DNA, 722 bp, Homo sapiens
  misc_feature: GYAE6OF01ALUNB.19.67.G01.1.454.CMB.1.raw
  modified_base (536)..(536): a, c, t, g, unknown or other
  misc_feature (536)..(536): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttggctgcaatttcaggaggtgtccagtgtgaggtgcaactggtggagactggcggaggcttggtaccaggccctggggcgttctctgacgtactgtccgtgtcgaacccctcgtgggggtctccgtcagcgagcgactgtattcgccgtcgggtccgccaggcctaccgaaggggagacgggccgggaggtcgggtcgacgtaggttatttttaggagggtacgggacgtacgtacgtttacgtaaccggtagtaccgtacctaggtcggggacgggtacccgtaacgttccaacccgtatccgtaccgtagtacgtttaccttttactactaaacgaaccactaccttcggttcctacttaacaaatacggaaaccncggtaccgtagggaccggggtaccggaacggaccggaaccgggttccgttaccgttaagtttacgtttggttacgtaggtaggttaagttttcgtagggtaccgtaggttcgggtaccggttggggttaccggaaggtaacggtcttacccgggacgggttacggggggcccgttaaacccggggg

SEQ ID NO: 44808 - DNA, 581 bp, Homo sapiens
  misc_feature: GYAE6OF01BSLYK.19.67.G01.1.454.CMB.1.raw
  modified_base (241)..(241): a, c, t, g, unknown or other
  misc_feature (241)..(241): n is a, c, g, or t
  modified_base (329)..(329): a, c, t, g, unknown or other
  misc_feature (329)..(329): n is a, c, g, or t
  modified_base (452)..(452): a, c, t, g, unknown or other
  misc_feature (452)..(452): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccagccagaactattttccnccacctaccaaagaaactaaaacttctacgcctaggtaaccaacagacgaccgaggaccacgccctactaagttgcctctatttacgnggtccttcgtacgcgacgtaacgttccggggtccctggacccgtaggttcccggggcacggcgggtcgtagggactagtactttccgactcctacaccatcgagcagcctgcaggctagagtntgtgctagtttactctgtcagtactaatttcttttctacttccgttacgtggtaccgtcgacgtaacgggaccgtagggtacgaacgtgaaggacgtaacgtggtacgtcgtcgaccactgtcgttacg

SEQ ID NO: 44809 - DNA, 694 bp, Homo sapiens
  misc_feature: GYAE6OF01COP1T.19.67.G01.1.454.CMB.1.raw
tcagtactctcgtgcacgaccggtgctcgatttagagtatacatattgggtttggggtgggagaggagcccagcactgggattccgaggtgtttccattcggtgctcagcactgaacacagaggactcaccatggagttttggctgaccttgggttttccttgctgctaatttcgaggaggtgtccagtgtgaggtgcaacgtggtggagacgtgggcggaggtcttggtccagccgtggggccggtctcgtgacgacgttgtcctggtacgaacccgttcgttcgggggttcctccgtcgagcacgcgtactgtattcgccgtcgggtcccgccgacggccgtaccgaaggggacggacgggccgggtaggtcggggtcgtacgtaagggtttacgtttttagtaggggtcgggaacgtaactacgttacgtaacgggagtaccgtcgtaggtcgggacgggccgtaattccaaccgtactccgtaccgagtacgttacgttttcacgaacgaactacctctacgtccttacttacaatacgaacacgtccgaggacgggaccgaacggtaccgaccgggtccttacgttaagttacgttggttaggtaggttaggttagtttacggtcggtagtaggttcgggtcgttgggtacggtacgtagacgtacggtacgggtcggggtaacccggg

SEQ ID NO: 44810 - DNA, 875 bp, Homo sapiens
  misc_feature: GYAE6OF01EHYIZ.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagccgtgggcggtctcgtgagactgtcctgtcgaaccctcgtcggggtctccgtcagcagcgactgtacgttcggccgttcggggtcccgccgacgggtcctacccggaaggggaaacggacggggacccggggtaggttcggggtccgacgtaagggttttaagtttttttaaggtaacggggttaggggaacgtaacgttaacgtttaccggtaaccggggaagaccgttacccgtaggttacgggggacggggtacccgtagtttacccgaaccgtacgttacccgttacccgaacggttaacgttaccgttttttaccaccgtaaacggaaacctaaccgtaccgtttcgttaccctttacctttaacgtaaaagttaccgaaaccgtaccggtacccgttaggggaacccggggtaacccggtaacggggtaacccgtacccggggtaccccggttttactttaaacggttttaacgttttacgggttaggtttacgggtaaagggttttaacggtttttaaggttcgggggtacggttaagggtttcggggtacggtttacggggttacgggaaaccggttaacggtaacggttacccggtaacggggttcccggggggaacccgggttaaacccccgggggg

SEQ ID NO: 44811 - DNA, 683 bp, Homo sapiens
  misc_feature: GYAE6OF01DGX2P.19.67.G01.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (431)..(431): a, c, t, g, unknown or other
  misc_feature (431)..(431): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (564)..(564): a, c, t, g, unknown or other
  misc_feature (564)..(564): n is a, c, g, or t
  modified_base (586)..(586): a, c, t, g, unknown or other
  misc_feature (586)..(586): n is a, c, g, or t
  modified_base (609)..(609): a, c, t, g, unknown or other
  misc_feature (609)..(609): n is a, c, g, or t
  modified_base (625)..(625): a, c, t, g, unknown or other
  misc_feature (625)..(625): n is a, c, g, or t
  modified_base (642)..(642): a, c, t, g, unknown or other
  misc_feature (642)..(642): n is a, c, g, or t
tcagtactctcgtgcacgaccggtgctcgatttagagtatacatattggggtttggggagaggagcccagcactgggattccgaggttgtttccattcggtgctcagcactgaacacagaggactcaccatggtagttttggctgacctgggttttcctgctgctaatttcaggagtntccagtgtgaggtncaagtggtagganacgtgggacggaggtcttcgggtaccaggtcccgtgggggtccgttcncgttggataccgtcgttcctaggtaaccgtacccttcggtggggtccttccggacagccgagcgtacttgtacgttcgcggtccggtccgcgagtccgaccgagggacgacgggcggaggttcggacgcgttaggttttattttaggagggtacggacgtactacgttacgacggtanccctacgtggttgggaacgccttaagtcccaatcttacccggactaacggtaagtttccctttacacgaagtaacctcgtacttcgtacctataanaaacgtnaacctgaccgtggaaccgggcaacgggacnccggttcctattagtttaacgngtacttaggtaaggttacggtancgggagtacggttggngggtacggtagtaacgngttaacggccggttaacgggtgggggaacccctaaccgggg

SEQ ID NO: 44812 - DNA, 767 bp, Homo sapiens
  misc_feature: GYAE6OF01BYPUN.19.67.G01.1.454.CMB.1.raw
tcagtactctcgtgcacgaccggtgctcgatttagagtatacatattggggtttggggggggagaggggcccacgcacctgggagttccgtacgggtggtttcctacttcggttggctcagcacctagaacaacagaggactcaccagtggtaggttttggtcgtcgtaccgttcgggtttttccgttttcgctcgctaaacttttacgtagggaagggttcgttcctaggttggttggagggttcgcaacgtgggtgggagaccgtgggcgggagggtcgttcggtccaggccgtcgggcggttctctaggagacttcggtccgttagtcggaacccctcgttggggtcctcccgtcgagcgagccgacttgtattcggccgtcggggtacccgccgacgggtcctacccggaagggggaacggacgggcccgggtaggtcggggtcgactaagggttttagtttttagtacggggcgggaacgtactctttacgtacgggacgtactaccgaggtggggaacgggtccgtacttcgaaccctattccgaccgtaaggagtttacccttttcacaaagtaacccactcgttacgtttccttacttaaccgtaaaatcgaaaaccgtcgtaccggtacggaacggggccaagggaacccacccggtccgttacttaagtttgttccgtagtaggaggttaacgttttgcggacgttgtgggtctgggagtacagcgttacccgaggtcggggaccgcgggtaacccg

SEQ ID NO: 44813 - DNA, 933 bp, Homo sapiens
  misc_feature: GYAE6OF01CUUYX.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccgttgggttttcctgctgctaatttcaggtaggtgtccagtgtgaggtgacaacgtggtggagacgtgggcggaggtcttgggccagtccgtggggcgttctacgtggacgtacttgtccctggtaccgtaacccgttcggttcggggttccttcccgtcgaacgccgacgccgtactggttacttcggccgttcggggacccgccgtaaggtcccgttaccggaaagggggaacggaacggggtcccggggtaaggggttcggggttacccggacgttaaagggtttttaagttttttttaaacggaggggttaaccgggggtaaccgttaaccgttaacgtttttacccgggaaaccggggtaacgttaaacccgtttacccggaaggttacggggggaaccggggttaccccgtaaacggttttaccccgaaaccctaacgttaccccgttaacccggttaaacggtaccggttttaaacccgtttttttaccgaaccgtaaacggtaaaaccctaaaccggttaaaccttccggtttacccttaacgtttaaccctaaaagttaccggaaacctacgggtaaccccgttacgggaaccggggaacccggtaacggggtacccgtaaccgggttacccgggttaacttacggttttaaagtttccgggttggtaacgggttaaggttacggtttagacgggtagtaggttacgggtacgtagggtaccgtaacgtacggtacgttaccggtaacggtccggggtaacccggtaaaccccgggg

SEQ ID NO: 44814 - DNA, 940 bp, Homo sapiens
  misc_feature: GYAE6OF01ESNVW.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcgaggaggtgtccagtgtgaggtgcaacgtggtggagacgtgggcggaggtcttggccaggccgtgggcgtctcgtgagtactgtcctgtacgtaacccgtcgtgggtcctccgtcgagcagcgactgtacttcggccgttcgggtcccgaccgacgggtccgtaccggaagggggtaacggacggggtaccgggtagggttcggggtccggacgttaagggttttaagtttttaggtacggggtggggaaccgtaacgtagtttccgtaacggacgtaccgtaccgaggttcggggaacggggtacccgtaactttacccgaacccgttaactttcccggttaacccgtaacgggttaaccgttttaacccttttttacccgtaaccgtaaaccggtaaaacccctaacggttaaccccggtttacggtttacccctttaacccgttttaaacccgtaaaaacggttaccggtaaaacccgtaacccgggttaccccgtaacggggtaaacccggggggaccccggtaaaccggggtaaccccggtaacccgggggttaccccgttttaacgtttaaacgttttacggttttaccgggtttagggtaacgggtttaaacgggtttaaacggttttacgggtttcggggtaacccgggttaagggttcggggttaaccggggttcggggttaacggggtaaccggtaagggttaacccgtaccgggtaaccggggtaccggggggtaaccccgggtaaaaccccggggg

SEQ ID NO: 44815 - DNA, 780 bp, Homo sapiens
  misc_feature: GYAE6OF01CTQPR.19.67.G01.1.454.CMB.1.raw
  modified_base (280)..(280): a, c, t, g, unknown or other
  misc_feature (280)..(280): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggagtgtccagtgtgaggtgcaacgtggtggagacgtgggcggaggtcttggtccaggccgtgggcggtctctgagctgtcctgtcgacctcggtcgggtctccgcngcagcgatgtatcgccgtcgggtccgccgaggctaccggagggacgcgggcggtgtgggtcgcgtaggttagttttaggaggtgggacgtacgtcgtttacgacgggactacctccgaaggtcggggacgggtccgtaacgtttaccaccgtacttaccgtaccgtaacggtacgtttacctttttaccgacgtaaacgtaaacctaccgttaacgttcgtttacccttaacgtttaaaccgaaaagttcgaaaccgtacggcccggttacgggaacggggttacccggaacggggtaacccgtacccggggttccgtttacttaacgtttttaacgggtttcggtacggtttagggaacggttttaaacggttttacgggtacggggtacccgggttaaggtttcgggtacggggtttaacgggtacggttaaacgtaacggttaccgttacccggtaaacggggttcccggggggaaccccgtttaaaccccgggggg

SEQ ID NO: 44816 - DNA, 704 bp, Homo sapiens
  misc_feature: GYAE6OF01DRLCZ.19.67.G01.1.454.CMB.1.raw
  modified_base (199)..(199): a, c, t, g, unknown or other
  misc_feature (199)..(199): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccgagtggtagttttggctgaccgttgggttttcctgctgctaatttcgaggtaggtctccgagtgtgaggtnactacgtggtgaagcgtggacggaggtcttggtaccagtccgtggcgtctacgtgacgtctcgtctgtaccgaccgttggtcgggttcctccgcgtacgcgacgcgtacgttgttacgtccgtccggtcggtcccgacgtacggcctacggaaggggacggcggacgggtaggttcggtacgacggtttaagtttaacggttttaggacgggtacggaactacgtacgttaaccggacggtacgtacccgtacgtagggtaggggacccggtccgttaaactttcccgaaaccgttacttaccgtaaccgtaagtttaccgtttacctttacgaacgtaacgaacctacgtaccttcgtaccctattaacaacgtacgtaactcggagtaccgggacggaccgtagcccggtacgttctattacgtgttgagtagtgtagtagcgtacggatcggttagacggtacgacgtagacgtaccggtcgggtacggacccgggtaccgg

SEQ ID NO: 44817 - DNA, 631 bp, Homo sapiens
  misc_feature: GYAE6OF01BNQ3K.19.67.G01.1.454.CMB.1.raw
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
tcagtactctcgtgcacgaccggtgctcgatttagagtatacatattggggtttggggggggagaggagcccagcactgggattccgaggtgtttccattcggtgctcagcactgaacacagaggactcaccatgggagttttggctgaccttgggttttccttgctgctaatttcgagggtaggtgtccagtgtggaggtgcgaacgtggtggagtacgtgggcggaggtcttggtccagccgtgggcgtctctgagactgtcctgtcgacccgtcgtgggtcctcgtcacgcagcgtatgtacttcgccgtgggccncgacggcctcggagggaaggcggcggaggtggtcngtagtttatttagaggtggacgangttacgacgagtactcgaagtgggacggcgtactccactatccgtacgtacgtacgttacgtttactacgaacgtaactactacgtactctacttactaacgtaacgacgacgtacgtacggacggaccggacggacggaccggtacgttacttcgttaaaaaaagttcgttagtagtagttagttagtacggtgtaggtggtcggtggtaggacggtacgtacgtacgtacggtacgggtccggtaaccggg

SEQ ID NO: 44818 - DNA, 860 bp, Homo sapiens
  misc_feature: GYAE6OF01DLR4I.19.67.G01.1.454.CMB.1.raw
tcagtactctcgtgcacgaccggtgctcgatttagagtatacatattggggtttggggggagaggagcccagcactgggattccgaggtgtttccatttcggtgctcagcactgaacacagaggactcaccagtggtagttttggctgtaccttgggttttcctgctgactaagtttcgaggtggtcgtccagtgtggaggtgctaagtgggtaggagtacgtggggcggaggtcgttcggccgaggtccggtgggcgtctcgtggagtccgttgtccgtggtaccgtaaccccgttggtcggggtcccttccggtacacggaccgtaaggtccgtaacgttcggttacgttccgggccggtttccggggtaccccgacggaccggtacccgtacggggaacggggaacggccggggtaccgggtagggttccgggttaccggacggtttaagggttttagtttttaacgggtacggggtaccggtaacgtacgtttacggtttacgggtaacggtaacggtaccgtaaccggtagggtacggggaccgtaccggttacttaacccgaaccgttacgtaccgtaccgtaacgggttaactttaccgtttacgaaccgtaaacggtaaaccctacgttaaccgttccgttaccgttaaccttaactaaaacgtacggtaaaccgaccggtacggaacgggtacgggtacccggaaggtaccccgtacgggtaccttacttaagggtttactcgggttaagtaggttaacgtaggttaacggtgggacgtaggtcgggtcggtacggtaacgacggtacgtacgtaccgggggtaccgtacgggggaaccctaacccggggg

SEQ ID NO: 44819 - DNA, 804 bp, Homo sapiens
  misc_feature: GYAE6OF01DI9RB.19.67.G01.1.454.CMB.1.raw
  modified_base (329)..(329): a, c, t, g, unknown or other
  misc_feature (329)..(329): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgctaatttcaggtaggtgtcctaggtgtgaggtgacaactgggtggagacgtggggacggaggtcttggtcccaggcccgtggggcgttctctaggagtactgtccctggtcgaacccgttcgtcggggtctccgtacagcagcgtactgtattcgcgtcggggtccnccgtacggcctaccggagggaaacggcgggtaccgggaggtcggggtcgtacggtaggtttagttttaaggtagggttcgggaacgtacgtagttccggtaacggacgtacctaccgagtacggggacgggaccgtacgtttaccaacgtactccgtaccgaaggacgtttaacctttacgtactaacgtaaccgtaacgtaaccgttcgtttaccttacccgttaaacgtaaaacgtaacgtaaaccgtaccggtacccgttacgggaaccgggggtaaccccgaacgggggtaccccggtaaccggggttacccggttacgtttaaccttttaggttaccgggtttaggtacgggttaaggttagttttacgggtacggtcggttaccggttagggttcgggtacggggtaggtaaccgtaaaggttaccgtacccgggtacggggtccggggtaacccgggtaacccggggg

SEQ ID NO: 44820 - DNA, 651 bp, Homo sapiens
  misc_feature: GYAE6OF01CUCVD.19.67.G01.1.454.CMB.1.raw
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
  modified_base (499)..(499): a, c, t, g, unknown or other
  misc_feature (499)..(499): n is a, c, g, or t
  modified_base (591)..(591): a, c, t, g, unknown or other
  misc_feature (591)..(591): n is a, c, g, or t
tcagtactctcgtgcacgaccggtgctcgatttagagtatacatattggggtttggggggggagaggagcccagcactgggattccgaggtgtttccattcggtgctcagcactgaacacagaggactcaccatgggagttttggctgaccttgggttttccttgctgctaatttcagggaggtgtccaggtgtggaggtgcaacgtgggtggagacgtgggcggaggtctttggtcccaggccgtgggcggtcggtcgtggacgacgcgtccgtagtacggacctgtgggtctccgtacagcaggcctatgtatcgccgtggtccncnggtcncgaggagcggtcgacgtggnacgngttagtttagacggtggagtcaacgttcacgggactacncgtagtgggacgggactaacgttccaacgattccgaccgagtaacgttccttcggtaaacacggaacctaggtaactctctacttaanaaaccgtagaaccncgacgacgggacggacgtccgggaacgttaccggtcgtttacttagttacggtgttacgtaggtacgttaggttgtacgggacgttaggggngttacggtaggtacggttaacgagtacgtaccgggtacgggccgggaaccggtaccgggg

SEQ ID NO: 44821 - DNA, 775 bp, Homo sapiens
  misc_feature: GYAE6OF01DLJJD.19.67.G01.1.454.CMB.1.raw
tcagtactctcgtgcacgaccggtgctcgatttagagtatacatattgggtttggggggagaggagcccagcactgggattttccgaggtgtttccattcggtgctcagcactgaacacagaggactcacatggtagttttggctgaccttgggttttccttgctgactaatttcgaggtaggtgtcctagtgtgaggtgactaagtgggtagagacgtgggcggaggtcgttcggccacggtccggtggggtccgtactcgtaggactacgttcggtccgtggtccgtaacccgttcggtcgggttcctaccgtcgacggcgagcgtacgttgttacgttcggtccggttcgggtccgccgacggtccgacggaacggggacggacgggcgggtaggtcgggtcgtagttaacggtttagttttaggtagggtacggacgtacgtacgttcgtacggactaccgtaccgtagtcggggacggtctaacttccgaaccacttccgaccgtaagtacgttaccttttacacgtaaacgtaacctaacgtcttacgtactttacctaaacgtaagtaccgaactaccgtaccggtacggtaacgggacccgggaacggaacccggtaccgggtacctttaacgtttaagtttacggtttagggtacggttaggtaaggtttacggtttacggtacgggtagtagggttcggtgggtcggttacggaacgtacggtaacgtacgggtaaccggtccggggaccgggttaaacccgggg

SEQ ID NO: 44822 - DNA, 872 bp, Homo sapiens
  misc_feature: GYAE6OF01B644D.19.67.G01.1.454.CMB.1.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgaccgttgggttttccttgctgctaaagtttcagggaggtgtccaggtgtgaggtgacaacgtgggtggagacgtgggcggaggcttggccagccgtgggcggtctcgnggacncttgtccgtgtaccgacccgttcgtcgggtcctccgtcgacgcgacgcgacgttgtattcggccgtcgggtccgaccgaggtccgtaccggaaggggaacggacgggcccgggtaggtcggggtaccgtacggttaggtttaacgttttttaaggtaggggtacgggaacgtaacgtacgttaccggtaacggacggtaccgtaacgtagggtacggggaaccggggttacccgtaacgttacccgaaccgtacgttcccgtaaccgtaacgggttaaccggttttaaccttttacgtaaccgtaaaccggaaaccctaaccgttaaccgtttcgttaccctttaaccgtttaaacgtaaaacgtacggtaaccgaaccggtacccggtaggggaaccggggtaccggaaacgggacccggtacccgggttaccgtttaacgtttaacgtttaggtttcgggttacggttacggttaaggtttaaacgggtttagttacggggtacccgtttaagggttcccggtaggggttaccccgggttaaagggacccgtaaggggttaccttaccggggacccggggtttaacgggggaccccggttaaacccggggg

SEQ ID NO: 44823 - DNA, 887 bp, Homo sapiens
  misc_feature: GYAE6OF01A7VWL.19.67.G01.1.454.CMB.1.raw
tcagtactctcgtgcacgaccggtgctcgatttagagtatacatattgggtttgggctgggagaggagcccagcactgggattccgaggtgtttccattcggtgctcagtcactgaacacgagagactcaccagtggtagttttggctgaccgttgggttttcctgctagctaatttcgaggtaggtgtccagtgtgaggtgcaacgtggtgagacgtggcggagtcgttggaccacggtccgtgggccggtcgttcgtggtacgtaccgttgtccgttggtacgtaacccgttcggtacgggttccgtccggtacgaggccgaggccgtacgttggttacgttcggtccgtcgggtcccgacgtacggtccgtaccggaagggaacggacgggtccggaggttccgggtccgtaacggttaggttttaacgtttttaggtacgggttacggaaccgttaacgttacgttaccggtaacggtacgttaaccgtcgtaaaggtcggggtacggtacccgtatttaaccccggaaccttacgttcccgttaaccggtaaggttaccgtttaacctttttaccgaaccgtaaaccgtaaacgtcccgttaacgttacccggtttccttaaacccgtttaaccgaaaagttaccgtaaacccggtaacgttacccgtaacggggaaccggggtacccggaaaccgggtaacccggttaaccgggttcccgttaaacggtttcgtttaacgtttacgggttaccggttaagggttaagttttaaccgggtttaggtaaacggggtccggtttaaacgggttcggggtaacggtttcggggtaccgggaaacgtaacggttaccggtccggttaacccggggtaacccggggg

SEQ ID NO: 44824 - DNA, 938 bp, Homo sapiens
  misc_feature: GYAE6OF01B77O3.19.67.G01.1.454.CMB.1.raw
tcagtactctcgtgcacgaccggtgctcgatttagagtatacatattggggtttggggggggagaggagcccagcactgggattccgaggtgtttccattcggtgctcagcactgaacacagaggactcaccatggagttttggctgtaccgttgggttttccttgctgctaatttcgaggagtgtccagtgtggaggtgcaacgtgggtggagacgtgggcggaggtcgttggtccgagccggtgggccggtcgtcgtggagtcgtgtccgtgtaccgtacccgttcgtcggggtcctccggtacacgcgacgtaccgtacgttagttagttccggtccggttcgggtccccggaccggtacggtccgtaccggaaagggggaacggacggggtccgggtagggtcgggtccgtcggttaaggttttagttttaacggtagggtacgggacgtaacgtacgtttacgacggtaacgtaccgtacgtaacggttggggaacggtacctaacgttacccgaaccgtacgtaccgtaacgtagttaaccgtttacctttttaccgaaccgtaaacgaaacccttaccgttaccgttacgtttacccgttacttaaaaccgtaaacgtaacggtaaccgtaaccgggtaccggttaccggggaaaccggggtacccgggtaaaccgggtaccccggtaaccgggtacccgttttaacgtttaacgttttaccgggttagggtttaaccgggttacgggttaaagggttttaccggttttaaacgggggtaccggtaaccggggtttaaggttaccgggggtttaaccggttaggggggttaaacccggaaaccgggttaaacgggtaccccggttaaccccggggttaaaccggggggtaccccgggggggttaaaaccccgggttaaaccccccgggggg

SEQ ID NO: 44825 - DNA, 706 bp, Homo sapiens
  misc_feature: GYAE6OF01B2O22.19.67.G01.1.454.CMB.1.raw
  modified_base (286)..(286): a, c, t, g, unknown or other
  misc_feature (286)..(286): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggtagttttggctgaccttgggttttccttgctgcaatttcaggagtgtccagtgtgaggtgcaacgtggtggagacgtgggcggagtcttggccagccgtgggcggtctcgtagagactgtccgtgtacgaccctcggtcgggtcctccgtnagcagcgtacgtgtattcgccgtcgggccgccgaggccgtaccggaaggggaacggacgggccgggtagggtcgggtcggtacttagggtttaatttttaggtagggtacgggacgtacgtagttccggtaacggacgtctccgaggtcgggacgggtcctagttacccacgtacttcctaccgaagttacgttctttactacaacgtaaccacgtactgttccttacttaaacaattacgaaccgtacgtccgtacggaacgggccggtaaccgggaaccggacccggggtaccgttacgtttaagtttagttacggtagtaggttaacgttgggtttagtcgggtacggtaggtcgggtcggttagggtacggaacgtacggtacgtaacgccggggtacgggaccgggtaacccggg

SEQ ID NO: 44826 - DNA, 828 bp, Homo sapiens
  misc_feature: GYAE6OF01BG0ZI.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgaccttgggttttcctgctgctaatttcgaggaggtgtccagtgtgaggtgcaagtggtggagtacgtgggcggaggtcttggtccaggtccgtggggcggtctcgtgagtactcgtaccgtggtaccgaacccgttcggttcggggtcctcccggtcgacgtccacggccgtaacgttgttacgttcggtcccggttaccggggtccccgcccggaacggtcccggttacccgggaaagggggtaacggaccggggacccgggtaacgggttcggggtacggtaccgttaagggtttttaacgtttttaaggaacggggttacgggtaaccgtaacgttacgttaccggtaacgggaacgtaacccgtccggaaggtacggggaacggtcccgtaacgttacccgaaccgtacgttacccgtaccggtaacggttaaccgtttaccttttaccgaccgtaaacgtaacctacctaacgttccgttacctaccttaacgtaaacgttacgaacgtaccggtcccgtagggtaacccggggaccggaacgggtaacccgacccgggttaccgttacttaaggtttcggttacggttaggtacggttaaggttacgtttacggagggtacggtagtcgggtcggtacgggtacggtacgaagtcgtaccggtacgggtaccgggg

SEQ ID NO: 44827 - DNA, 712 bp, Homo sapiens
  misc_feature: GYAE6OF01CHZIU.19.67.G01.1.454.CMB.1.raw
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
  modified_base (458)..(458): a, c, t, g, unknown or other
  misc_feature (458)..(458): n is a, c, g, or t
tcagtactctcgtgcacgaccggtgctcgatttagagtatacatattgggtttgggacaacaggcaggcaggggcagcaagatggtgttgcagacccaggtcttcattttctctgttgctctggatctctggttcctgcggggacatcgtgatcgacccagtacccagacctcacgtggctgtgtctcgtgggcgagccggccaacaatacaactgcaggtccagcaagaactcttttccnccacctaccaaagaaactaaaaaccttcttagcctacggtaaaccaacagacgaaccgaaggaccagtccctaccgttaagttcgacttactaattttacgngggtcctttacgtacgtcgtacgtaaacggttccggggtccctcggaccgtacggttccgggagtacggtcgggtcgtacgggactacgtaactttcgacttacctccaaccctnaccgtagccgacgtccgtgtaccgaggtacctaaggaaacgtggttcggtcggtaactttaaggttttaccttacgtcgtacgtactacgtttaaacgttttctttttacgtacctttccgttacggtacgggttaccgttccggtaaccggaaagggtacccgttagggtaagtaaacgtccgtaaaccgggtaatcggtttacgggcttaccgacgtaccctaccgttactcccgtttcgtccttaacccgg

SEQ ID NO: 44828 - DNA, 676 bp, Homo sapiens
  misc_feature: GYAE6OF01BQE1Q.19.67.G01.1.454.CMB.1.raw
  modified_base (551)..(551): a, c, t, g, unknown or other
  misc_feature (551)..(551): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgctgcaatttcaggtagtgtccagtgtgaggtgcaacgtggtggagacgtgggcggaggcttggtccaggtccgtgggcggttctcgtgagtctgtcctgtcgacccttgtgggtctccgtcacgcagccgacgtgtacgttcgcccgttcggggtccgccggacggtccgtaccggaagggggtaacggacgggccgggtaggtcggggtccgtacggttagggttttaagttttttaggtagggtcggggtaacgacgtagtttacggtacgggaacgtaccgtaccgtaggtcggggacgggtacctagttaccgacctacgttccgtaccgagtacgtaccttttcgacaagtaacactacctgttacctacttaacaacgtagaacngtcccgtagggaaccgggtccgaggaccggccgggtacttagttatttagtgttgtagtaggttagtttagacggtcgtgtagggtgtcggagactaagtcgtagcgggtgggaccgtaaccggg

SEQ ID NO: 44829 - DNA, 620 bp, Homo sapiens
  misc_feature: GYAE6OF01EKRMM.19.67.G01.1.454.CMB.1.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
tcagtactctcgtgcacgaccggtgctcgatttagagtatacatattgggtttgggacaacaggcaggcaggggcagcaagatggtgttgcagaccccaggtcttcatttctctgttgctctggatctctggttcctggcggggacatcgtgatgaccccagtacccagactcactggctgtgtctcgtgggcgagaccggccacaatcaactgcacggtccagccagaactntttccaccacctaccaaagaaacctaaaaacttctacgcctaggtaaccaacgagacgaccaggacacgcccttacctaagttcacttntacgtttacgtgggtccttaccgtacgcgtacgtaacggttccggggtccctggacccgtacgttccgggctagggccgggtcgtacggactagtacttcactctccacctatcanccngtccngtcaggtctagagtacgtggagtacgttagtttactactgtacagtactaagtttacttttcgtactcccgtcggttcggtaccgttcggaccgtaacgggtaccgagggttagaaacgtccgacgtaacggtacttgggtccgcgtacgaccacttattcttcggtcttaccg

SEQ ID NO: 44830 - DNA, 827 bp, Homo sapiens
  misc_feature: GYAE6OF01DUPIX.19.67.G01.1.454.CMB.1.raw
tcagtactctcgtgcacgaccggtgctcgatttagagtatacatattgggttgggggggagaggagcccagcactgggattccgaggtgtttccattcggtgctcagcaatgaacacagaggactcacatggtagttttggctgcgttggttttcctgctgctaattcgaggtaggtgtcagtgtgaggtgactaacgtggtaggagacgtgggcggaggtcgttggtccaggtccgttggggccgttcctcgtggtacgtacgttcgtccgttaggtacccgtaaaccccgttcggttcgggggttccttcccggtaccgtacgaccgtacggtaccgtacgttacgttacgttcggtcccggttcggggtcccggaccgacgggtcccgtaccgggaacggggaacggacgggtaccgggtagggttcggggtacggtaccggttaagggttttaagtttttaacggtacggggtacggggtaccggtaacgttaacggtttaacggtaacggtacgtaacgtacccggtaggtacggggacgggtaccgttacgttacccaccgtacgttccgtaccgtaagtaccgtttaccgttttacgacgtaaacgtaaccgaacctacgtttccttacccgtttacttaaccgtaaacgtacgaacgtcgtacggtacgggaccgggtaccggaacgggtaaccggtaccgggtccgttaacgttagttagttcggttagttaggtaggttggttaggtggttacggtagtcggtcgtagggacgtacgtacgtagtaccggtacgggtccgggtacggtaacccgggg

SEQ ID NO: 44831 - DNA, 705 bp, Homo sapiens
  misc_feature: GYAE6OF01BXYQM.19.67.G01.1.454.CMB.1.raw
  modified_base (234)..(234): a, c, t, g, unknown or other
  misc_feature (234)..(234): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcgggacatcgtgatgacccagtacccagactcactggctgtgtctcgtgggcgagacggccacaatcaactgcaggtccagccagaactattttccnccacctccaaagaacctaaaaacttctacgcctggtaccaacagagaccaggacacgcctacctaagtgctctatttacgtgggtcttcgtacgcgcgtaacgtttccggggtccctaggacccgaggtttcccggggctaagggtcccgggggttcgtacggggacctaacggtaacttttcccgaccttccttacaaccctatccaacggccacgcccgttagcgtaacgggtcctaggaaacgtattagggtcgtaccgttagttttaaacttacccgtgtaccgtagtaaccttaaattttccgtttttttacgttaaccgttcccgttacccgggttaggggtaaccccgtttcggacccggtaaacggggtaccgtagggggttaacgtaaatccggaacggtaccggtaaaccgttggtccggaccgttcgacccctaacttacgtttcttacgttccttaccg

SEQ ID NO: 44832 - DNA, 768 bp, Homo sapiens
  misc_feature: GYAE6OF01AL3LM.19.67.G01.1.454.CMB.1.raw
tcagtactctcgtgcacgaccggtgctcgatttagagtatacatattgggtttgggggggagaggagcccgagcactgggattccgaggtgtttccattcggtgctcagcactgaacacagaggactcaccatggagttttggctgaccttgggttttccttgctgcaatttcaggaggtcgtccagtgtgaggtgcaacgtggtggagacgtggcggtaggtcgttggtccagccgtgggcggtctcgtgagactgtcctgacgtaccgtcgtcgggtctaccgtcacgcagcgtacgtgtacgtcgtccgtgggtccccgccgaggtcccgtaccggaagggaacggaccgggccggtaggtcgggtcgtacggtaggttttattttaggtacgggtacgggaacgtacgtacgtttacgtaacggacgtaccgttacgaggtcggggaccggtaccgtactaccgaaccctacgtaccgtaccgtaggtaacgtttaccttttacccgacaaaccgtaacctaaccgtactttaccgttaccttaccgttaacctaaacgtacggtaacctacggtacccgacgggaacgggtaaccccggaacggtacccgacccggggttacctttacgttaacgtttacggtggttacggtaacgttagggtttaaacgtttaccgggtaaggggtacgttacgggtcgggtttccggaggttacggaacgtaggtacctaccgggacggttacggggaacccgtaccgggg

SEQ ID NO: 44833 - DNA, 750 bp, Homo sapiens
  misc_feature: GYAE6OF01B9VJQ.19.67.G01.1.454.CMB.1.raw
  modified_base (179)..(179): a, c, t, g, unknown or other
  misc_feature (179)..(179): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagtttttggctgaccttgggttttccttgctgctaatttcaggnggtgtccaggtgtgaggtgcaacgtgggtggagacgtgggcggaggtcttgggtccaggccgtggggccggtctacgtgacgtactgtcctgtacgaccttcggtcggggtcctccggtcagcgagcgtacgtagtacgttcggcccgtcggggtccccgccgtaacgggccgtaccggaaagggggaacggacggggtcgggagggttcggggtaccgacgtaagggttttagtttttaggacgggtacggggaacgtaacgtacgtttacggtaaccggaagtacccgttaccgaggtacggggacggggtaccctaacgtttacccaaccgtattcccgtaccgtaagttacgttaccttttactacgaaacgaacctacgtacttcgttcttaaccttacgtaaatcgaaactacggtccggtagggacgggacccgaaggtaacccggccgggttcgttaacttaagtttaacgtgttacggtaggtaagtttacgttaggtcgggtacgtaggtcggtcggtgggagtacaggtacctcgggacggtacgggggctaacccgggg

SEQ ID NO: 44834 - DNA, 700 bp, Homo sapiens
  misc_feature: GYAE6OF01EE8NQ.19.67.G01.1.454.CMB.1.raw
  modified_base (327)..(327): a, c, t, g, unknown or other
  misc_feature (327)..(327): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcgggaggcttgggtccagccgtggggcggtctcgtgagctgtcctgtcgaccctcgtgggtctccgtcagcagcgactgtattgccgtgggtccgccgaggctccgaggggagngggccggaggtgggtcgcgtaggttatttttagtagggtgggacgtacgtagtttcgtaacggagacctccgagttgggacgggtcccgtattacccaccgtactcctaccgaaggtacgtactttttcgacgtaacgaaaccactacttcgttccttacgtttactaaacgttagaaacctacggtcccgttagggaacggggcccggtaacgggaccgtacccggggtccgtttactttaagtttgttagggttcgtagggtagttaggttttaggtagggtaccggttaaggttgggtcggtttcggggtacggaacgtaaggtaaccgttacgggaaccgggttcggggaccccggtaaacccgggggg

SEQ ID NO: 44835 - DNA, 683 bp, Homo sapiens
  misc_feature: GYAE6OF01DZLHJ.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgctgctaatttcaggagtgtccagtgtgaggtgcaactggtggagacgtgggcggaggctttggtccagccgtgggcggtctcgtgagcgtgtccgtgtcgaacccgtcgtggggtctccgtcagcagcgactgtatgccgtgggtccgcgcggctccgagggaaggacggccgggagtgggtcgacgtaggttattttagtagggtgggacgacagttcgtacggagtaccgtcagtggggacggcccgtattaccacgtactctccgaagtacgttacttttacctacgaacgtaaccaactacttcgttacttcctttaacgaaacttacgaaccgacgaccgtagggacgggacccgaagggaccgacccgggtaccgttcgttagtttagttggttgtaggtacgttaaggttttacgtggggtaccgttaaggttcggggtacggttacggggttagggaaaccgtaaggtacgttaccggtaacgggttccgggggaccccggttaaacccgggggg

SEQ ID NO: 44836 - DNA, 665 bp, Homo sapiens
  misc_feature: GYAE6OF01DLNKE.19.67.G01.1.454.CMB.1.raw
  modified_base (412)..(412): a, c, t, g, unknown or other
  misc_feature (412)..(412): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtgggcggaggcttggtccagccgtgggcggtctctgagactgtcctgtcgaaccctctggggtctccgtcagcagcgactgtattgccgtgggtccgcaggctccgagggaagaggccggaggtgggtcgcaggttatttttagaggttgggacgactattcgtacggagactccgaagtgggaacgggccgattccgaacctntacctcccgagtacgtactttttccacaagaaccactacttcgtacttccttacaaatgaacacgcccgtggaacggggccgaacgggaaccgaccgggtacccgttacgttaacgtttagtttcggtaggttagggaacggtttaacggtttttaggtacggggtaccggtaaggtttggggccggtttagggggttacgggtaaccgtaaggtacgttaccggtaccgggttcggggggtaaacccccggg

SEQ ID NO: 44837 - DNA, 867 bp, Homo sapiens
  misc_feature: GYAE6OF01EYE58.19.67.G01.1.454.CMB.1.raw
tcagtactctcgtgcacgaccggtgctcgatttagagtatacatattgggtttggggggagaggagcccagcactgggattccgaggtgtttccattcggtgctcagcactgaacacagaggactcaccagtggagttttggctgaccgttgggttttccttgctgcaatttcgaggaggtgtcagtgtgaggtgcaacgtgggtggagacgtgggcgggagtcgttggccaggccgtggggccggtctcgtggacgtcgtcgttccgtcgtaccgtacccgttcgggttcggtcctccgtcgacgcgacgaccgtagttgttacgtccggtccgggttccgggccccgaccggacggtccggtaaccgggaaggggtacggaccggggtacgggtacgggttcggggtaccgtaagggtttaaggtttttaaggttttaagggaacgggtacggggtaaaccgtaacgtttaacggttaaccgggtaaacggtaccgtaacccgtacgggtaagggtaccgggggtaaccgggtacccttaaccggttacccaaccgttacgttacccgtaccgtaacgggtttaacccttttacctttaccgaaacggtaaacctaaaccgttaccgttacgtttaccttaccttaacgtaaaaccgtaacgtaaccggaaaccgtcggttaacccgggaggggtaaccccgggtacggtaaaccgggacccggttaccggttaaccgttagttttaagtttcgggttaggttacgtagggttaagtttaggttagtcgggtaacgtggtggtcggttaagggacgtaacggtagacgttaccggaccggggttcggaacccgggttaacccggg

SEQ ID NO: 44838 - DNA, 845 bp, Homo sapiens
  misc_feature: GYAE6OF01D06T9.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccaggccgtgggcggtctctgagtctgtcctgtacgaccttcgtcgggtcctccgtcgacgcagcgacgttgtagttcgccgtcggggtcccgccgacggccgtaccggaggggaacggacggggccggtagggttcgggtcggacgtaggtttagtttttagtacggggtagggtaacgtactaagtttccgtaacgggacgtaaccgtccgaaggttcgggggaacggggtacccgttaacgtttacccaacccgttaacgttcccgttaccccgtaaggttaaccggtttacctttttttaccgtaccgtaaacggtaaacccaaccttaaccggttccgtttaccctttacgttttaaaccgaaaacgtttaccggaaaaccgtacgggtaacccggttacggggaacgggggtaaccccgggaaccggggtaacccggaccgggggttacccgtttaccggtttaagtttacgtttgggttacggttaggttaaggttacgttttaggggtccggtacggttacggttagggtcccgggtttagggtacgggtaaacgtacggtaacggttaccggtaaccggggttccggggggacccggttaaacccgggggg

SEQ ID NO: 44839 - DNA, 857 bp, Homo sapiens
  misc_feature: GYAE6OF01DOYE1.19.67.G01.1.454.CMB.1.raw
  modified_base (332)..(332): a, c, t, g, unknown or other
  misc_feature (332)..(332): n is a, c, g, or t
  modified_base (447)..(447): a, c, t, g, unknown or other
  misc_feature (447)..(447): n is a, c, g, or t
tcagtactctcgtgcacgaccggtgctcgatttagagtatacatattggggtttgggggggagaggagcccagcacgtgggattccgaggttgtttccattcggtgctcagcactgaacacagaggactcaccatggtagtttttggctgaccttgggttttccttgactgctaactttcgaggtaggtctccgtaggtgtggacggtgacgtaacgtgggtacggagtacggtgggcggtggtccgttcggtccgaggtcccggtggggccgttctacgtgacgtcgttcgtccgtgtacgtaaccccgttggtccggggttcctccgtanacggtctaacggcgttacgttggttacgttcggtcccgggttacggccgccgtaggtccgacggaagggtaacgcgggccggtagggtccgtgtacgtttagttagttttacggnggggtacgactacgacgtttcggaacggtagtacccttacgaggttacggggaccgtacgttaccgttaacaaccctagtttcccgtaaccggtacttaacggtttaccgtttaccgtaaccgtaaacgtaaccgtaacctaccgttaacggttaccttaccgttaaacgtaaaccgttaacaacgtaccggtaccggttacgggaaccgggtaccggaaccgggtaacccgtaaccggttaccgttaacgtttaccgtttaaggttcggttaagtaccgggtttaaggttacggttttacggaccgggtttaggtaccgggtttacggtcggttaagggtccggtaacgtaacggttacggttaaccccggtacggggttaccccgggaaccccgggttaaacccgggg

SEQ ID NO: 44840 - DNA, 788 bp, Homo sapiens
  misc_feature: GYAE6OF01A0U19.19.67.G01.1.454.CMB.1.raw
  modified_base (719)..(719): a, c, t, g, unknown or other
  misc_feature (719)..(719): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagtttttggctgtaccttgggttttcctgctacaatttcgaggagtgtccagtgtgacggtgcaacgtgggtggagacgtggggcggagggtcttgggtcccaggtcccgtggggcggttctcgtggacgtacttggtcctggtacgtaacccctggttcggggttcctccggtcagcgagccgtacgtgtattcgccggttgggtaccccgccgagggcctccgggaagggaaggacgggcccgggtaggtcggggtcgtacgtaaggggttttatttttaagggaggggttacggggtacgtaacgtaacgtttccggtaaacgggacgtaccgtacctagggttcggggaaggggtacccgtactttacccgacccgtaacttccgtacccacggtaacgttaccgttttccacggtaaacgaaaccctacgtaaccgttcgtacccttacgtttaaccgaaattccggaaacgacggtacccggttagggaacccggggtaccggaacgggtaaccggacccggtaccggttttaaccttagttttacgttagttggtggtaaacggtttgtttaacggnggtacgtaggtggtccggtagggttccgaagtagtcgtacggtacggcggggccggtaccggtaaccgg

SEQ ID NO: 44841 - DNA, 775 bp, Homo sapiens
  misc_feature: GYAE6OF01EJV3N.19.67.G01.1.454.CMB.1.raw
  modified_base (178)..(178): a, c, t, g, unknown or other
  misc_feature (178)..(178): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagttttggctgaccttgggttttcctgctgcaattcaggagtntccagtgtgaggtgacaactggtggagaccgtggcggagtcttaggtccaggtccgtggggcgtctcgtggacgactgtcctggtcgaaccccgtcgtcggggtccttcccgtacgacggacacgacgaaccgttggttaactttcggacccgttacgggggtaccccgaccgtaggggaccttacccggaaggggaaacggaaggggcccgggtaaggtcgggtcgacggttaaggttaagttttttaagaacgggttagggaaccgtaactaagtttacgtaccgggtaaagtacctaccggtaagtggggtaacgggtccgtaaacgttaccaaacctaagtcccgtaccgtaacgtaacggttaacctttttcgaacctaaacggaaacctaccgtaacttacggtaccttaacgttaacaaaacgttacgaaccgtacgaccggtagggaacgggacggtaacggaacgtaaccgggtcttacttaaagttagttaggttcggtagtaacgtacggttttacgcgggacggtaagttggggtccgtaggtaggacgtagaacgtacggtacgggtacgggccgtaaaccggg

SEQ ID NO: 44842 - DNA, 696 bp, Homo sapiens
  misc_feature: GYAE6OF01AUGUF.19.67.G01.1.454.CMB.1.raw
  modified_base (176)..(176): a, c, t, g, unknown or other
  misc_feature (176)..(176): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttcctgctgcaatttcgaggagtntccagtgtgaggtgcaacgtgggtggagactgggcggaggcttggtccagccgtgggcgtctcgtgagctgtcctgtacgaaccctgtcggggtctccggtcacgcacgcgactgttacttcgccgtcggggtcccgcgacggcctccgaaggggaacgacgggccggaggtcggggtcgacgtaggttaatttttagagggttacgggacgactagttcgtacggagacctccgagtcggggacggccgtattccacactcctcgagacgttccttttacgacaacgaacacctaacgttcgtccttactttaacaaacgtacgaacaacggtccgtaggtacggggacccggtaagggtaaccgaacccgggttccgtttaacttaacgttttagtttgggttaacgttcgggtaagttaacgggttttacgtaggggtacctaggtccgggttacggtacggggttacgaacgtacggtataacccggcgggtcgggggtaccctaaacccgggggg

SEQ ID NO: 44843 - DNA, 739 bp, Homo sapiens
  misc_feature: GYAE6OF01CT4QP.19.67.G01.1.454.CMB.1.raw
  modified_base (109)..(109): a, c, t, g, unknown or other
  misc_feature (109)..(109): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (495)..(495): a, c, t, g, unknown or other
  misc_feature (495)..(495): n is a, c, g, or t
  modified_base (578)..(578): a, c, t, g, unknown or other
  misc_feature (578)..(578): n is a, c, g, or t
  modified_base (614)..(614): a, c, t, g, unknown or other
  misc_feature (614)..(614): n is a, c, g, or t
  modified_base (674)..(674): a, c, t, g, unknown or other
  misc_feature (674)..(674): n is a, c, g, or t
  modified_base (691)..(691): a, c, t, g, unknown or other
  misc_feature (691)..(691): n is a, c, g, or t
tcagtactctcgtgcacgaccggtgctcgatttagagtatacatattgggtttggggctgggagaggacgcccagcacgtgggattccggaggttgtttccattcggtnctcagcactagaacagagagactcacgagtggtagtttgctgtaccgttggttttcctgctgactatttcgagggtacggtgtaccgaggttgtggtacgggtcgaccgaaggttgggtaggacgtacggtggggccggagtcgttcgggcccagggtccggtggggtccgtactcgtggaaccggtacttcgaccgtaggtaccgacccgttggttcgggaccttcccganagccgaggcgtaacttagtnttccggacggttaccggcccacggacgtcgaccggaaaggggaccggacgggtcgggtacggtagggtccgtaaggtttagggttttatttaggggacgggagggtaaccactttagttacggaacgggtaccncggttaacgagggttcggggacgtaccgtattacccaacgtactaccgtaccgtacgtacgtttacctctaagaccgtaaacncgttacttcgtcttaattacgaatacgacgtaccgnggtacggacggacggaagcccggtacggacgttcttagtacgttgtacgtaggtaggttntcgggtagtggttcggngggtacggttaggaccggttagaagccgtccggtacgggtacccgggg

SEQ ID NO: 44844 - DNA, 725 bp, Homo sapiens
  misc_feature: GYAE6OF01AR2O5.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaagaggtgtccagtgtgaggtgcaactggtggagactgggcggaggcttggtccagcctgggcgtctctgagactgtcctgtgaaccctctggggtctccgtcagcagcgactgtatgcctgggtccgcaggctccgagggaacgaggccggagtcgggtcgcgtaggtttagtttttagtagggtcgggaccgtacgtattccgtaacggacgactccgagtcgggacgggccgtatttccgaccgtataccgttccgaaggtacgtaccgtttttctacctaacggtaaacccaccgtaacgttccggttacctttaccgtttaaccgtaaaacgttaccgaaaccgtaacggtcccgttacggggaaccggggtacccggaacgggtacccgtacccggggttacccgttaacgtttaagtttacgttaggttacgttagggtaacggttaaggttttaacgtcgggtaccggttaagttcggggttaccgttggggttacggtaacgttaacgggtaccttaccgggtaccggtaccgggggtaacccggg

SEQ ID NO: 44845 - DNA, 716 bp, Homo sapiens
  misc_feature: GYAE6OF01DBQFK.19.67.G01.1.454.CMB.1.raw
  modified_base (557)..(557): a, c, t, g, unknown or other
  misc_feature (557)..(557): n is a, c, g, or t
  modified_base (711)..(711): a, c, t, g, unknown or other
  misc_feature (711)..(711): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatcgacccagtaccagactcacgtggctgtgtctcgtgggcgagaccggccaagaactcgaacgtgaccgtaggtccacgaccaagtaaccttacttttccacccaacctaacaaaacgtaaaactaaaaacctttcgtacgtaccctacggtaacccaacgaacgaacgtaaccaacggacacgtaccgtaaccgttaagtcgtcctactaacgtttccgtcggtccttccgacgtccgtacggtaaccggtttcccgggcctacggacccgtacgggttccgggacgtacgggtccggggtagtacgggactaacgtcgtttccaccttcgaccacctagtcacgcgtacgtcgcgtacgcgtagtagaagtgtaggtccgtactttaagtttctcgtntaccgtattaacgtttaactttttacgtttttctaccgttccgggttccggttacggtacccggttacggaaccggtaacgggtacggtaagggtaactaaacgtaccggaaaggttcccggaaacgttggccgttaacgctactaactcgttntaccg

SEQ ID NO: 44846 - DNA, 724 bp, Homo sapiens
  misc_feature: GYAE6OF01EF4B8.19.67.G01.1.454.CMB.1.raw
tcagtactctcgtgcacgaccggtgctcgatttagagtatacatattgggtttggggggggagaggagcccagcactgggattccgaggtgtttccattcggtgctcagcactgaacacagaggactcaccatggtagttttggctgaccttgggttttccttgctgctaatttcgaggaggtgtccagtgtgaggtgcaacgtgggtggagtacgtgggcgggaggtcgttggtaccaggccgtggggcgtctcgtggagcgtgtccgtgtacgacccgtcgtcggggtcctccgtcagcgagcgactgtattcgtccgtcggggtcccgccgacggccgtccggaagggaacggacgggccgggtaggtcgggtcggtacgtaggtttattttaggtagggtacggaacgtactacgttcgtacggacgtacctaccgtagtacggggacgggtaccgtattaccaacgtaacttcctacgtacgtacgttaccttttactacgtaacgaaccaacgtacgtcgttccgttacttaactaaactacgtaacctacgtccgttagggacggggaccggaacgggaccgtacgggtacccgttacgtttagtttagttcggttagttacggtaggttagtttaggtcgggtacggttagtcgggttcggtagggtacggtacgtaacggttactacggtcggacggggtccggtaaacccgggg

SEQ ID NO: 44847 - DNA, 725 bp, Homo sapiens
  misc_feature: GYAE6OF01DUE4W.19.67.G01.1.454.CMB.1.raw
  modified_base (253)..(253): a, c, t, g, unknown or other
  misc_feature (253)..(253): n is a, c, g, or t
tcagtactctcgtgcacgaccggtgctcgatttagagtatacatattgggtttggggctggggagaggagcccagcactgggattccgaggtgtttccattcggtgctcagcactgaacacagaggactcaccatggagttttggctgaccttgggttttccttgctgctaatttcaggagtgtccaggtgtgaggtgcaacgtgggtggaggacgtgggcggaggtcttggtccaggccgtgggcggtctcngagtactgtcctgtctaacccgtcgtcggggtcctccgtcagcagcgtactgtattcgccgtcggggccgccgacggccgtacggaggggaaggacgggccgggaggtgggtcgacgtaggtttattttaggagggtggaaccgtactagttacgtacgggactaccgtaccgtagtacgggacgggtccgtagttaccaacctacgttcctaccgtaacgtagttaacccttttccaacgtaacgtaaaccaccgtacgttcgtttaccttaccgtaacgtaaacgttacgaaccgtacggtaccggttaccgggacggggacccggtaagggacccgtacccggggttcttaacgttatttacggttggttacgttaggtaggttacggtttacggtcgggtaacggttggtcgggtagggttagggtacggtaacgtagggtaaccgttcggtaccgggttacgggggg

SEQ ID NO: 44848 - DNA, 847 bp, Homo sapiens
  misc_feature: GYAE6OF01ARXAT.19.67.G01.1.454.CMB.1.raw
tcagtactctcgtgcacgaccggtgctcgatttagagtatacatattgggtttggggggggagaggagcccagcactgggattccgaggtgtttccattcggtgctcagcactgaacacagaggactcaccatggtagttttggctgaccttgggtttttcccttgctgcaatttcgaggaggtgtccagtgtgaggtgacaacgtgggtggacgacgtgggcggaggtcttgggtccaggccgttggggcgtctcgtgacgtactcgttcctgtacgaaccccgtcggttcggggtcctccgtaccgaggccgacgcgtactggtacttcggcccgttacgggtcccgccgacggtccgtaccgaagggggtaacggacgggtccgggtagggttggggtccgcgttaagggttttaacgttttttaaggtaacgggttcggggaaccggtaactacggtttacgtaacgggtaacgtaccgtacccgaggttacggggaccgggtcccgtacgttaccgaacccgtaacgttccgtacccgaggttaacgttaccctttttacgaccgtaacgaacctacctaaccgttcgttacccttaccgtttaacaaacgtacgaaccgtaaccggtccgtaacggggtaccggggacccggaaacgggtacccggtacccgggtacccgttaccttaagtttaccgtttacggttagggtaagtaagggttaacgttttacggtagggtacccggttaaggttcgggtcccggtttaggggtaacggaaccgttacggttacgtaacccgggtaaccggggttcccgggggacccggttaaacccggggg

SEQ ID NO: 44849 - DNA, 822 bp, Homo sapiens
  misc_feature: GYAE6OF01BK9JN.19.67.G01.1.454.CMB.1.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (516)..(516): a, c, t, g, unknown or other
  misc_feature (516)..(516): n is a, c, g, or t
  modified_base (561)..(561): a, c, t, g, unknown or other
  misc_feature (561)..(561): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatgggagttttggctgacctgggttttccttgctnatatgaggtgtcacgngtgnggtacggnactacggtggacgacgnggtcggagggcgtcgttcgacgcggtcgggtcgggtcgtctcgtagacgtntccgtcgtgaaccgtccgttcggtcggtccttcgacgcgngacgcgtacgttagttcgtccgtcggtaccggccgtacggacgtccgacggaagggacgccgggcggtaggtcggcgtaacggttagttttaagtttagggcggggacgtaacgtacgttacgttacgggaacggtactccgtacggtaggaccggggtaccgacgttcgaacctacgtctaccggaacgtacggttaacttttccttacggaanaaaaccctaccctagtttaccggttacttacttaaccggttaaanaaaccggtcgaacgtcccggtagggaacccgggggtaacgtacccgggaaacggttccccggtaccccggttttaacgtttaaggtttaaggtttacggtttacggggacgttaaaggggttttaggttttaccgggttaacggggtcgggtaccggtttaggggtccggggtttaacgggtaaggtacgggaaaccttacggttaccgggtttacccggggaacccgggggggtcccggttaaacccggggtaaccccgg

SEQ ID NO: 44850 - DNA, 703 bp, Homo sapiens
  misc_feature: GYAE6OF01BJHVW.19.67.G01.1.454.CMB.1.raw
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (392)..(392): a, c, t, g, unknown or other
  misc_feature (392)..(392): n is a, c, g, or t
  modified_base (693)..(693): a, c, t, g, unknown or other
  misc_feature (693)..(693): n is a, c, g, or t
tcagtactctcgtgcacgaccggtgctcgatttagagtatacatattgggtttgggggagctacaacaggcaggcaggggcagcaagatggtgttgcagacccaggtcttcatttctcttgttgctctgatctctggttcctgcgggacatcgtgatcgacccagtacccagactcacgtggctgtgtctcgtgggcgagaccggccacaatcaactgacacggtccagccaagtactacttttccaccacctaccaaagaaacctaaaacttctacgcctacggtaaccaacgagtacgaccgaggacacgtcctacgtagtcnctctatttacgnggtccttacgacgcgtacgtacgttccgggtcctagtaccgtacgttcccggggntacggtccgggtcgtacggggactagtactttacgaccttctaccaaccgacgtcgaacgtccgacggtacccctggaacctacggggtcctaaggtaacgtgtttacggggtagttaccgttaaggtttttaacctcgttacgtaccgtaagttaaccctttaaacgtttttcttttttaccgaccgttaccccggttgggtaccgttacccgggtacggtaccccgaagggtacccggtaagggttaccggaactacgtaaggaccgttacgtggttacggccttacgacctaaccgtnttcggttacg

SEQ ID NO: 44851 - DNA, 803 bp, Homo sapiens
  misc_feature: GYAE6OF01D2XI9.19.67.G01.1.454.CMB.1.raw
  modified_base (233)..(233): a, c, t, g, unknown or other
  misc_feature (233)..(233): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggtagttttggctgaccttgggttttccttgctgctaatttcgaggaggtgtccagtgtgaggtgcaacgtggtggagacgtgggccggaggtcttggtaccngccgtgggtcgtctcgtgacgtctcgtcctgtacgtacccgtcgtgggtcctccgtcgagcacgcgtacgtgtattcgtccgtcgggtccgccggtacggccgtacggaggggaaggacgggcccgggaggtcgggtcggtacggtaaggttttaacgtttttaggtaaggggtacggggtaacgtacgttaacgttacggtaaccggtaacggtaccgttaccgagggtacggggtaacgggaccgttacgttaccgaaccttacctccgtaaccgtaaggtaaccttacctttttaccgtacgaaaccggtaaaccctaacgtaaccgtttcgttaccctttaaccctttaaacgtaaaacgttccggaaaccgtaccggtacccggttgggaaccgggacccggaaccgggtaacccggccgggtacccgtttacgttaagttttgtagggttcgttagggtaacgttagggtttaacgtgggtacggttagttcgggtcggttacgggtacggtaacgtacgtacggtaccggaaccgggtccgggtaacccggtaaccccggggg

SEQ ID NO: 44852 - DNA, 704 bp, Homo sapiens
  misc_feature: GYAE6OF01AYU20.19.67.G01.1.454.CMB.1.raw
  modified_base (596)..(596): a, c, t, g, unknown or other
  misc_feature (596)..(596): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccttgggtttcctgctgctattcgaggagtgtccagtgtgaggtgactaacgtgggtggagacgtgggcggaggtcgttggtccaggtccgtggggccggttctcgtggacgacttggtccctggtaccgtaaccccgttcggttgggggttcctccggtaccaggtacacggtcgtacgttagttacgttccgggtcccggttcggggtccccgaccggacggtcccgtccggaagggggacgacgggcccgggtggtcgggtccgtacggttaagggttttacttttaggagggtcgggtaacctaacgtacgttaccggtaacgggacgtaccgtaccgtagggttcgggaacgggtacccgtatacccaccgtactcccgtacgaacgtacgttaccttttacacgtaacgaacctactacgtcttactcgtaacaatacgacncgtctggacgggtccgaggtccacgggtcttacgttagttagttcggtagtgtagttagttacgaggtgagtcggtacggtgtacggtacgatcgtcgcggttacggg

SEQ ID NO: 44853 - DNA, 735 bp, Homo sapiens
  misc_feature: GYAE6OF01BXFGX.19.67.G01.1.454.CMB.1.raw
  modified_base (171)..(171): a, c, t, g, unknown or other
  misc_feature (171)..(171): n is a, c, g, or t
  modified_base (318)..(318): a, c, t, g, unknown or other
  misc_feature (318)..(318): n is a, c, g, or t
tcagtactctcgtgcacgaccggtgctcgatttagagtatacatattggggtttggggagaggagcccagcactgggattccgaggtgtttccattcggtgctcagcactgaacacagaggactcacatggagttttggctgacctgggttttcctgctgcaatttcaggnggtgtcagtgtgaggtgcgaactggtggagacgtgggcggaggtcttgggtccaggtcccgtggggcggtctcgtgacgtacttgtcctgtcgtaacccgtgtcgggtctccgtcgagcagcgactgtattcgcgtcgggtccgcgnggcctcgagggacgacgggccggtaggtcgggtcgacgttaggttattttaggagggtgggacgtacgtacgttacgtacggagtaccgtcgaggtcggggaacgggtccgtattaccgacctacgtacctccgtaaggtacgttaccttttcaccgaagtaaccacgtaaccgtcggttaccttacgttacaaagttaccggaactacggtaccgtagggaaccgggacccggaagggtaacccgtaccggggttacccgttactttaacggttacgtttcggttagggttacggttaaggttacgggtttttaggaccggggtagttaccggtaggggttcggttacgggtaggtaaccggttacggtacccgttaccggtaccgggttaccgggggacccgtaaaccccggggg

SEQ ID NO: 44854 - DNA, 571 bp, Homo sapiens
  misc_feature: GYAE6OF01E2X6Y.19.67.G01.1.454.CMB.1.raw
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (436)..(436): a, c, t, g, unknown or other
  misc_feature (436)..(436): n is a, c, g, or t
  modified_base (510)..(510): a, c, t, g, unknown or other
  misc_feature (510)..(510): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggagtgtccagtgtgaggtgcaactgggtggagactgggcggaggcttgggtccagccgtgggcggtctctgagctgtcctgtcgaccctcgtggggtcctccgtcagcagcgactgtattgccgtggtccnccnggctccgaggggaagaggccggtagtcggggtcgcgtaggtttattttagaggttgggacgactattcgtacggagtacgtccagtgggacgggcctattccacactcctacgagtacttcctttcncaagaactaccattgtcctctacaatcaacacgcgtggaccgggcgaggaccacggtcttactagttcttaggngtagtagtggtttntgggcgtaggtcggtgtggggtaggactaggctacggcgtccggggg

SEQ ID NO: 44855 - DNA, 851 bp, Homo sapiens
  misc_feature: GYAE6OF01AHZPJ.19.67.G01.1.454.CMB.1.raw
  modified_base (120)..(120): a, c, t, g, unknown or other
  misc_feature (120)..(120): n is a, c, g, or t
  modified_base (749)..(749): a, c, t, g, unknown or other
  misc_feature (749)..(749): n is a, c, g, or t
tcagtactctcgtgcacgaccggtgctcgatttagagtatacatattgggtttggtgggagaggagccctagcactgggattccggaggtgtttccattcggtgctcagcactggaacanagaggacctcgaccatgggattttcggctgaccttgggttttcctggctgcctaagttttcgacgggtaggtcgttccgaggttggtggaagggttgacctaaaccgtgggtagggacgtaccgtggggacgggtagggtccgtttggggtacccaggtcccgtgggggtccggttcctcgtaggtacgacgttcgtccgttaggtaccggaacccccgttggtcgggggttacctcccggtaccaggccaggccgtacctggtatttccggcccgttcggggtaccccgccgaggtccctacccggaaggggtaaaccgaccggggccgggtagggttcgggtaccgtaccggtaagggtttttaatttttaacggaggggttacggggaacctacggtactttaccggaacggtaacgtaccctcgaaggttcgggggaaacccgggtcctagtttacccgaccgttaagttcccgtaccggtagttacgtttaccttttcacccgtaaagtacccgacttaacgtcgttacttaaccgtactaagaccggtaacacggtcccgtagggaacccgggtacgaacggacccgtaaccgggtccgtactttagttcggttagtagggtntaagggtttacccgttaggttcccggagggttacgtcggggtaccgttagggtcccggaagtacggtacgttaccccggtacggggttcgggaaaccccggg

SEQ ID NO: 44856 - DNA, 861 bp, Homo sapiens
  misc_feature: GYAE6OF01BF09O.19.67.G01.1.454.CMB.1.raw
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
tcagtactctcgtgcacgaccggtgctcgatttagagtatacatattgggtttgggggagctacaacaggcaggcaggggcagcaagatggtgttgcagacccaggtcttcattttctctgttgctctggatctctggttcctggcgggacatcgtgatcgacccagtacccagactcactggctgtgtctcgtgggcgacgaccggccaanaactaccaacgtcgcgtacggtccacgacccaagtaaccttcttttaccncccaaccctaccaaaacgaaaacctaaaaaccgtttcttaaccgcccgtaacggtaaccaacgaagacgaaccgaggaaccacgcccttaccgtaagttcgtaccttactagtttaccgtcgggtccttccgaccgtcggtaccgttaacggttcccggggtaccctcggtaacccggtcggttcccggggacgtacggtccggggtacgtacggggtaacctacggtttacctttaccgaaccgttccctaaccgtaccctagtaccgaaccggtccgtacgtaccccgttggacccgtaagggtacccgtaaaggaacggttccggttagggttaccgggttaacttttaacggtttttaaccgttacgtcggtaacccttaagtttaacccttttaaattttttacccgtttttacttacccggttcccggttacccgggttacgggtacccggttacccgggaacccggtaaacggggttccgggtaaacggggtttaccgaaacgttcccgggtaaacgtcccggtaaacggtttcgggaccgggtttaacccctaccgggtaacccttcccggttaaaggtttcccgttacgg

SEQ ID NO: 44857 - DNA, 881 bp, Homo sapiens
  misc_feature: GYAE6OF01BJGQW.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccgtgggtttttccttgctgctaatttcaggaggtgtccagtgtgaggtgcaacgtggtggagacgtgggcggaggtcgttggtccagccgtgggccgtctcgtgagctgtcctgtcgaccctcgtcgggtcctccgtcacgcgagcgtacgtgtagttcgccgtcgggtcccgccgtacggccgtacccggaaggggaacgggacgggcccgggtaagggttcgggggtacggtccggtaaggttttaagttttttacgggtaagggttacggggaaccggtaagttacggtttaccgtaaccgggaacgtaacccgttacccgtaagggtcggggaaccggggtaccggtaacggtttacccaacccgttacgtccccgttaacccggaacgttaaccggttaacccttttttcccgtaaccgtaaaccgtaaacccgttaacccgttaccgttcggtttacccttaccgtttaaaccgtaaagttaaccgtaaaccgacgtcccgttacggggaacccggggtaacccgggtacgggaaccccggttaacccgggttccccggttacgtttaaacgttttagtttcgggttaggttacggttaaagggtttaacgggttttacggtttaacggggcgtttacggggttcggttaccggggtttaacgggggtcggaaacggttaagggttaacccgttccgggttaaccggggttaacccccgggggggg

SEQ ID NO: 44858 - DNA, 898 bp, Homo sapiens
  misc_feature: GYAE6OF01CFPPW.19.67.G01.1.454.CMB.1.raw
  modified_base (859)..(859): a, c, t, g, unknown or other
  misc_feature (859)..(859): n is a, c, g, or t
tcagtactctcgtgcacgaccggtgctcgatttagagtatacatattgggtttggggctgggagaggagcccagcactgggattccgaggtgtttccattcggtgctcagcactgaaacacagaggactccacctagtgggtagtttttggctggtaccgttgggtttttccttgaccgtgctaaatttcgagggacggttcgtccgaggttggtggtacggttgaccgtaacggttggggtacggtaggtaaccgttgggggaccggggtacggttccgtttcgggtacccgtacggtccggtttcgggggccgtttccgttaccgtaggtaccggtaaccgttcggttaccccgttggttaccgtaaacccccgttcggttccgggggttaccctccgtaccgtacggcgacgcgtactggttacgtcggtacccggtcgggtccccgccggtacggtacccgtaccgggaggggaacgggtaccgggtccgggtaacgggtcggggtacccgtaggttaacggttttagttttaaggttacgggaggggtaaccgtaacgttacgttaccggtaacgggtacgtaccctaacggtacggtacgggaacggttacctacgttaccgtacccgtacgtcccttaaccggtacggtttaacgtttaccctttacgaaccgtaacggtaaaacccttacccgtaccgttaggtttccctaacgtttaacgtaaaccgttacgaacccgttaccgtacgggtaccgggaccgggtaaccggacgaacccggttaccgtccggttaacttagtttaccggagttcggtagtagttaccggttaggttgacgttaggttcggngttaccgggtagtacacgttcgccggtcgggtaccgggg

SEQ ID NO: 44859 - DNA, 820 bp, Homo sapiens
  misc_feature: GYAE6OF01CNPLF.19.67.G01.1.454.CMB.1.raw
  modified_base (248)..(248): a, c, t, g, unknown or other
  misc_feature (248)..(248): n is a, c, g, or t
tcagtactctcgtgcacgaccggtgctcgatttagagtatacatattgggggtttggggagaggagcccagcactgggattccgaggtgtttccattcggtgctcagcactgaacacagagactcaccatggtagtttggctgtaccgttgggttttcctgctgactaatttcgaggtaggtgtccaggtggtggaggtgactaaggtgggtagggagtacgtggggcgggacggtcgttcgggaccnggtccggttgggggccgttctcgtggacgtcttcggttcctggtacccgtaacccgtttccgggtcgggggttccctccggtacgacggacgtaccggacgtacgttgttacgttccgggccgttccggggtcccgaccgtacggccgtaccggaaaggggaacggcgggtaccgggtgggtcgggtccgtaggttaaggttttagttttaaggaggggttacggaaccgtaattacgttaccggtaacgggtaacgtacccgtaccggtaaggtaccgggggaaccgggtcccgttaacttaccccgaacctacgttccccgtaaccgtagtttaccgtttacccttttacgaaccgaaacggttaaaccacccgttaacgtttcgtttaaccttaacctttaaaggaaacgttaacggaacctacgggtaccggtacgggacgggaccggtaacggtacccgaccgggttaccttattagttgtacggtaggtagtagttaggttggcggtaggtcggtgggcgttagggagacgtagtaccgtacggcgggtcggggtaccgtaccggg

SEQ ID NO: 44860 - DNA, 830 bp, Homo sapiens
  misc_feature: GYAE6OF01AL5WF.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttctattttctcttgttgctctggacttctctggttcctggcgggacattcgtgactcgacccacgtaccagacctcacgtggcttgttcgtcgtcggtcgggacgaccggaccgaccaacgtaactaccaacgtcgaccgacggtccacgaccgaagtaacctttcttttcccacccgtaacctaacgaaaacgtaaaacccttaaacgtttcctacggtacccgtaacgtaaccaacgacggaaccgaaccgacggtacctacccgtacccgtttaacgttaacggtccgaccttaacgtttacgtttaccggccgggttaccttaacgtaccgggtacggtaccgtttaaccgggtttcccggacccgtaccggtacccgggttacgggtccgggacgtcggggtccggtacggtaaccggacttaacgtttccttacctaacccgtctacccgaaccgtcgtacgacccgtcgaccgttcgtacgacgggtacgtacgttaagggtaccgtaggttcccggtagttacgttttagtttaacgtcgttaccgaattacgtacttttaacgtttttcttttccgacggtttcccggtaacggtttccgggtaaccgttcggaaaccggaagggtttaccgggtaaggttaacgaacggtttaccgtcgtaacgggttccaacggtacgttaccgtctaaccgtttcgttggttaccttcg

SEQ ID NO: 44861 - DNA, 734 bp, Homo sapiens
  misc_feature: GYAE6OF01AZKAO.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcaggaggtgtccagtgtgaggtgcaactggtggagacgtggcggaggccttggtccagccgtgggcgtctcgtgacgactgtcgtgtcgtaaccctcgtggtgtcctccgtcacgcagcgtactgtacttcgccgtcgggtccgaccacggctaccgagggtaacggacggtccggtaggtcgggtccgacgttaggttaagtttttaagtacgggtcgggtaacgtaacgtaggtttaccgtaacgggtacgaccgtccgtaagtcggggaacggtaccgtaacttccgacctaacgttcctaccgtaagtacgttaccttttacgtaccgaacgtaaacctacgtaccgttcgtacctttacgttacctaaagtacgtaaacgtacgtaccgtacggacggggtaccggaacgggtaccgtaccgggtacccgttaacgtttaacgtttagttcggttaggtacggtaaggttaacggtttagtacgggtaccggtaaggttcggtacggttacgggtagtaaccgacggtaagtcccgtaacggtcggggtaaaccccgg

SEQ ID NO: 44862 - DNA, 998 bp, Homo sapiens
  misc_feature: GYAE6OF01B2PX3.19.67.G01.1.454.CMB.1.raw
tcagtactctcgtgcacgaccggtgctcgatttagagtatacatagttgggtttggggggggagaggagcccagcacgtgggattccgaggtgtttccattcggtgcgtcagcactgaacacgagaggactcacagtggtagttttggctgtaccgttggttttcctgctgactaagtttcgaggtaggtcgtccgtagttggtggacggtgacgtaacggttgggtaggacgtaccggtggggaccgggtacggttccgtttcgggtaccctacggtccccggttagggggtcccggtttaccttccggtacgggaacgtaccgttttacggttcccgttaggttaaccccggtaacccggtttcgggtttcgggggttcccttacccggtacgacggtaccgaaggacccgttaacgtttaggtttaaccggtttccggtaccccggtttccgggggttacccccgacccggttaaccgggtccccgttaaccggggaaggggggtaaaccggaccggggttaccccggggttaggggtttccgggggttaccggtaaccgggttttaaaggggttttttaacctttttttaaaggggacgggttaccgggggtaaacccgttaacggttaacgtttacccggtaaccggggaacgttaccccgttaccggtaggttacgggggaaccggtaccgttacgttaccccacccgttacgttaccgtaacccgtaaggttaccgtttaccgttttacgacgtaaacgaacctaccgtacttccgttacttaccgtaactaacgtacgaaccgtcgaccggtggaacggggcctacgggtacccgtaccggttacctttaagttacgtttacgtacggttacggtaggtacgttaggttttacggcgggtacgttaaggttcgggcgggttaacgggtacggtaaccgtaaggttaccgtaccggttacggggtacccggggtaaccggttaccccgggg

SEQ ID NO: 44863 - DNA, 829 bp, Homo sapiens
  misc_feature: GYAE6OF01A2MW4.19.67.G01.1.454.CMB.1.raw
tcagtactctcgtgcacgaccggtgctcgatttagagtatacatattggggtttggggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagactggcggaggcttggtccagccgtgggcggtctcgtgagactgtcctgtcgaaccctctcggggtctccgtcagcacgcgactgtattcgccgtcgggtccgcgaggcctaccgagggaagacggccggaggtcgggtcgcgtagggttactttttagtaggggttggggaacgtacgtaacgtttccgtaacgggaacgtaaccgttccgtaacggttacggggacgggggtacccgtaacgtttacccgaacccaacgttcccgttaacccgaaggtacggttacccttttttaccgacgaaacggtaaaaccctaacgtaaccgtttcggttaccttaccgtttaaacaaaacgtttacgaaacccggtacggtaccctttacgggggaacccgggggaaccccggaacggggtaacccgtaacccgggggttccccgtttaacgtttaaacgttttaccgttgggttcggttaacgggtaagggtttaacggttttaaggtacggggttaccggttaacggttcggggtacggtttacggggggtaacggaacggttaacggtacgttaacccgggtaacccgggttcgggggggaaccccgttaaacccggggggg

SEQ ID NO: 44864 - DNA, 753 bp, Homo sapiens
  misc_feature: GYAE6OF01C25GX.19.67.G01.1.454.CMB.1.raw
  modified_base (736)..(736): a, c, t, g, unknown or other
  misc_feature (736)..(736): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggtagtttggctgaccttgggttttcctgctgctaattcgaggtagtgtccagtgtgaggtgactaacgtgggtaggagtacgtgggcggtaggtccgttcgggtacccaggtccggtggggtccgtacctcgtggaacgtcgttcggtcctgtaccgtacccgttcggtcgggtcctccgtacacgcgacgcgtacgttgtacgttccggtaccggtcggtcccgacgtacggtccgtaccggaaggggaacggacgggtccgggtaggttcgggtaccgtacgttagggttttaagtttttaaggacgggttacgggtaacgtaacgttacgttaccggtaacggtaccgtaccgtaccgtagggtacgggtacggtaccgtacttacccgacctacgtcccgtacgtacgttacgtttacctttacgaaccgtaacgaactaccgtaccgttcgttaccgttactaactaacgtaccgtaacacggtccgtacggacggaccgtacggaccgtccgtcgttacttagttagtggtaggtagtacgttagttacggtcggtagtggtcggtcggtacggtacgtacgtacggtatacccgggngggtccgggtaacccgg

SEQ ID NO: 44865 - DNA, 792 bp, Homo sapiens
  misc_feature: GYAE6OF01DVJOP.19.67.G01.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
tcagtactctcgtgcacgaccggtgctcgatttagagtatacatattgggtttgggggagctacaacaggcaggcagggcagcaagatggtgttgcagacccaggtcttcatttctctgttgctctggatctctggttcctgcgggacatcgtgatgacccagtaccagactcactggctgtgtctctggcgagcgtccanatcaatgcaggtccagccagactatttcncaccgtcaagaactaaaacgttctacgcctacggtaccaacgtagagaccgaggacgtactaccgtccgtaagtttcaccttctatttacgngggtaccttcgtaccgcggtacgtaacttccggggttacctggaccccgtagttcccggggataacgggtcggttacgtcgggaactacggttaactttccgaacttccgtaacacccgtaacggttaccaacggtcaaccggccccgtttaggccccgttaagggaccttacgggaaacgtaagttccggtttaagggaccctttaaaggtttttaaccgttacggtacggttaccgtaagttaaccgttaacttttttaacgtttttacccgtttacgttaccccggtttaaccgggtgggttaccccggttttaaccgggcccggttaaaaccggggtacccgtaaacgggggtttaacggtaaaccgtaggttaaacccgggtaacccgttaaaggtttcccgggttacggtaaacccgttcggggttaacccccaaccggtttaaacgtttcccggttaaaccgg

SEQ ID NO: 44866 - DNA, 906 bp, Homo sapiens
  misc_feature: GYAE6OF01AQPTR.19.67.G01.1.454.CMB.1.raw
tcagtactctcgtgcacgaccggtgctcgatttagagtatacatattgggtttgggggggaggaggagcccagcactgggattccgaggtgtttccattcggtgctcagcactgaacacagaggactcaccatggtagttttgggcttcggtaccgttggggtttttccttggcctgtactaagttttcgagggaggttcgttccctaggtggtggtaggtggcctaaggtgggtaggacggaccgttggggccggtagggtcgtttgggtccgacggtccggtcgggtccggtacttcgtggtacgtacgttcggttaccgtcgttaccggtaaccccgttcggttcgggggttccctaccgggtccgaacggcgtacggccggtacttacggttattcgggtccccggttcggggttccccgaccgtaccgggtaccgtccggaaggggaacgggcgggcccgggtaagggttcggggtcggtacgtacgggttttaaggtttttaagggtacgggttacggggtaacggtacgttaacggtttacgttaaccgggtaacggtcgttaaccgtagggtaccggggaccggggtacgttaccgttacgaacccgttacgtcccggttaacgaacggttaacgttttacctttaccgtacccgttaaggaaaccaacccgttaagttccgttaaccgtactttaacgaaacgttaacgaacgtccggtaacgcggggtaacggtcccgggaacggaccgggtaccgttaccggtactttatttacgggttattacgggttagtagggtttacttacgggttaggtccgggtttaagcgggtttcgtaggggttagaacgggttcgtaacggtacctaccggggtacgggacccgggtaaacccggg

SEQ ID NO: 44867 - DNA, 928 bp, Homo sapiens
  misc_feature: GYAE6OF01BQ8T8.19.67.G01.1.454.CMB.1.raw
  modified_base (216)..(216): a, c, t, g, unknown or other
  misc_feature (216)..(216): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttcgctctggatctctggtcctggcggggacagtcgtgatcgacccagtacccagactcacgtggctgtcgtctcgtgggcgacgaccggaccanaatcaacgtgcaggtaccacgaccaagaaccttacttttcccacctaacctaacaaaacgtaaaacctaaaaacctttccgtaacgtaccgtaacggtaaacccaaacgaacggtaacgaacccgaacggaacctaccggtaccccttaaccggttaaacgttccgtaccgttacttaacgtttaccgtcgggttaccttaccgtaaccggtacggtaccggttaaccggttcccggggtaccctacggaacccggtacggttcccggggaccgtagggtccgggtacgtacgggaactaacggttaccgtttaccaccgttaccctaccgaaacccgttacgtaccgtaacgtaccgtaaccggtaccggttaacggtaccggaacgggtttttttttttaacggaaacggtaaacgggttacggttacgggttacggttaacggttttaacggttttaaccgttttaacggttacggttaccgtaacggttaaccttttaacgtttttaacgttttttaacccgtttaacccgtttacccggtttacccgggttaccgggttacccgggttacccgggtaaacccgggtaaaccggggttaaaccgggtaacggggttaaaccgggtaaacggttaaccggtaacggtaaccgggtaacggtacggtacggtaccggtaccgtaaccgtaaccgtccgttacgttaccgg

SEQ ID NO: 44868 - DNA, 732 bp, Homo sapiens
  misc_feature: GYAE6OF01BY4EX.19.67.G01.1.454.CMB.1.raw
  modified_base (602)..(602): a, c, t, g, unknown or other
  misc_feature (602)..(602): n is a, c, g, or t
tcagtactctcgtgcacgaccggtgctcgatttagagtatacatattgggtttgggggagaggagcccagcactgggattccgaggtgtttccattcggtgctcagcactgaacacagaggactcaccagtggtagtttttggcttgaccgttcgggtttttccttgcctgactaatttcgaggtaggtgtccgagttgtgaggtgacaagtgggtaggagacgtggccggagcgttggtccagccgtgggcgtctcgtgacgtacttcgtcctgtacgtacccgtgttcgggtcctccgtcacgcgagccgtacgttgttacgttccggtcccggttcggggtccccaccgacggtcccgtaccgggaaggggtaaacggacgggtaccggggtcgggttcggggtaccgtacgtttaggtttaatttttacggtaggggttcggaaccggtaacgttaccgttacggttaaccggacgtacccgttaccgaaggtcggggtaccgggtactacgttacccaccgtacgttccaccgtagtaccgttactttcgaactagtaaccgacgttactcgtaccttagttacaaacgtacgaacncggtcgtacggacggtccgaaggtaccctcgggtaccttagtcgtttagtgtgtagtacgtgttgacggtgtacgtggtgtcgggacgtacgtacgtacgtacggtcgggtcggggtcccgtaaacgggg

SEQ ID NO: 44869 - DNA, 705 bp, Homo sapiens
  misc_feature: GYAE6OF01D5W3V.19.67.G01.1.454.CMB.1.raw
  modified_base (197)..(197): a, c, t, g, unknown or other
  misc_feature (197)..(197): n is a, c, g, or t
tcagtactctcgtgcacgaccggtgctcgatttagagtatacatagttgggtttggggggggagaggagcccagcactgggattccgaggtgtttccattcggtgctcagcactgaacacagaggactcaccatgggagttttggctgaccttgggttttccttgctgcaatttcaggaggtgtccagtgtgaggtnacaagtgggtggagacgtgggcgggaggtcttggtccaggcctggggcgtctctgagactgtcctgtacgaaccctcgtggggtcctccgtcagcagcgactgtattcgccgtcgggtccgccgacggccgtaccggaggggaacggcgggccgggaggtcgggtcgacgtaggtttagttttagtagggtacgggacgtactacgttacgacgggacgtacctccgagtcggggaacgggtccgtattacccactactacgacccgtaagtaccggttaccttttcctacgaaacgaaacctacctacgttcgttaccctttactttaaccgaaatttaccggaacgacggtacccgtagggacggggaccgaacggtaccgaccgggttcccgttattacgtttagttaggtggtagtaggttagtttaggtacgggtcgtagggtacggtgttcgggtaacggaactacggtactacggtacgggtgggaacccggtaaccgggg

SEQ ID NO: 44870 - DNA, 626 bp, Homo sapiens
  misc_feature: GYAE6OF01DZ45X.19.67.G01.1.454.CMB.1.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtcgnaacgtggtggagactgggcggagcttggtccagcctgggcgtctcgtgagactgtcctgtcgaacctgtgggtctcgtnagcagcactgtatcgccgtgggtccncgagctccgaggagcggcggagtggcgcgtagttattttagaggtggacgatattcgtaacggataactctaagtcgggagggtccgaattcaaccgattccaccgtaagtacgttactttcaacgaacgtaacactatcggttaccttactttaacaaagtcgaacgtcgtaccagggacggggtaccacgggaccgtaaccggtccgttactagtttagttggtagtagtaagttaggtttagacgggtgtgttaccgggngttacgggtaccgggaatacggaacggtacgtaacggggtcggggtacccgtaaaaccgggg

SEQ ID NO: 44871 - DNA, 778 bp, Homo sapiens
  misc_feature: GYAE6OF01C65OL.19.67.G01.1.454.CMB.1.raw
  modified_base (214)..(214): a, c, t, g, unknown or other
  misc_feature (214)..(214): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcgggacatcgtgactcgaccctagtacccagactcacgtggctgtcgtctcgtgggcgagaccggccanatcaactgacaggtccagccagtaactatttccacaccgtacaaacgtaactaaaacttctagacctaggtaaccaagagacgaccgaggaccagtacccgtaccttaaggtctactacttacgtttacgtcggtcttacgtaccggcgacggttaaccggttcccggggtacctacggtacccggtacggtttcccgggggactacggggttaccggggtacgttaacgggggacttaccgttaacgtttttacccgaaccctttccgtaacccgaaccctttagaacccgacgggaccctaacgggtccccgttagggacccggtaccggggtcttaaaagggtacggtaccggtttggtaccgggttaacgtttaacggtttttaaccttacggtcgttactaaggtaccttttaagttttactttttcgtacgtcccggttacgttaccgggtcgttaccggaccgggtaaacgggtcggtaacgggttaaggaaaccttgggaaacgtaccggttacggttcgtacgggtaccacggacctaactcgttcgtttacccg

SEQ ID NO: 44872 - DNA, 829 bp, Homo sapiens
  misc_feature: GYAE6OF01AL7KW.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgcaatttcgaggtaggtcgtccaggttgtggaggtgactaacgtgggtaggagacgtgggccggtaggcgttggacccgagcccgttgggcgttcgtgtacggaacgtacgtcgtccgttggtaccgtaaccccgtcggtcgggtcctccggtcgagcgacgcgtactaggttacttcggtccgtcggccgaccgacggtccaccggaagggacggacgggtaccgggtaggtcgggtacgtacggttaaggtttaacgtttttaaggacgggtacgggtaaccgtacgttaacgttaccgtaacggacgtaacgtaccgtacggtagggtaaccgggtaccgtaacgtaccctaaccgtacctaccgttaaccgaggttaaccggttacctttaccgtaacgtaaacgaaaccgtaacgtaaccgtttacggtacccttacgttaaaccgtaaacgtacgaaaccgttacggaccggtacgggtaaccggggaacccgtaacgggtaaccgtacccggggttactttaacgttacgtttaacgttacggtaaggttcgtaacggttagtttagggtacgggtacgttagggtcgggtacgttacggggtcgtaaacgtaaggtaccgtaccgggtacgggtacggggttaacccggtaaaccggg

SEQ ID NO: 44873 - DNA, 691 bp, Homo sapiens
  misc_feature: GYAE6OF01CGGY4.19.67.G01.1.454.CMB.1.raw
  modified_base (244)..(244): a, c, t, g, unknown or other
  misc_feature (244)..(244): n is a, c, g, or t
tcagtactctcgtgcacgaccggtgctcgatttagagtatacatattggggtttggggggagctacaacaggcaggcaggggcagcaagatggtgttgcagacccaggtcttcatttctctgttgctctggatctctggttcctggcgggacatcgtgatcgacccagtacccagactcactggctgtgtctcgtgggcgagcggccaacaatcaactgcaggtccagccagaactattttccnccacctacaaagaaacctaaaacttctacgcctaggtaaccaagacgacgaccgaggaccacgaccctacgtaagttcacttactaatttacgtgggtcttcgtacggcgtacgtaacggttccggggtaccctacggaccggtacggttccggggacacgggtccggggtacgtcgggaacctaggttaccttttaccaccgttccctacaacctatccgacggcacgtcctaggaccgtagggactaaggacgtagttacggtcggtacgtttaagtttacgttaccgtgtaaccgtaagtactttaaatttttcgtttttaccgtaccgttccggttaccggtacgggtaccgttcgggaaccgtaaaccggggtacgtagggtaaggtaaactgtaacggtacccgtacgttggtacgtcctacgacctacgtgttccgtacg

SEQ ID NO: 44874 - DNA, 716 bp, Homo sapiens
  misc_feature: GYAE6OF01ARWGR.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgggtggtggagacgtgggcggaggtcttggtccagccgtgggcggtctcgtgagctgtcctgtcgaccccttgtcggggtctccgtcgagcacgcgtactgtattcgccgtggggtccgccgaggcctccgaaggggagacgggccggagggtgggacgcgtaaggtttagtttttaaggtgggtcggggaacgtagtacgtttaccgtaacgggataaccgttccaggtcggggacgggtccgtacttccgacctacgtcctaccaggtacgttaccttttacgcgacgtaaaccgtactaacgtttcgtaccttacgttaacaaagttcaaaccgtcggtcccgtaggggaccgggaaccggaacgggacccgtaccgggtcccgttacttaagtttacgttacgttaggtacgtagttaaacgtttaggtcgggtacggttagtacggggtcggtttagggacgggaacgtaggttaacgtacgggacccgggtcggggaacccggtaaaccgggg

SEQ ID NO: 44875 - DNA, 725 bp, Homo sapiens
  misc_feature: GYAE6OF01DTZ7F.19.67.G01.1.454.CMB.1.raw
  modified_base (407)..(407): a, c, t, g, unknown or other
  misc_feature (407)..(407): n is a, c, g, or t
  modified_base (699)..(699): a, c, t, g, unknown or other
  misc_feature (699)..(699): n is a, c, g, or t
tcagtactctcgtgcacgaccggtgctcgatttagagtatacatattgggtttggtgggagaggagcccagcacgtgggattccgaggtgtttccattcggtgctcagcactgaacacagaggactcaccagtggtagttttggctgtaccttgggttttccttgctgctaatttcgagggaggtgtccaggtgtcgaaggttgacacgtgggtggaagacgtgggcggtaggtcttcgggtcccaggtcccggtgggccggttactgtacgaggtacttcgtacgtgtcgtaacccgttcgtcggggtcctaccgtcgacgcctaagcgtactgtacgtcgtccggtcggtccgacgtcggcgtccgagggacgcggcggaggtcgggcgacgtagttattttagngggtgaacgactagtcgtaacggacgtacgtccgaggcgggtacgggctacttccgacctactaccgactacggttacgttacctttaccttacgaaactaaccgtacttaccgttcgttaccttaacgttaccgtaaagtaccgtaaacccggtagttacccggtacgggaccggggttccgaaccgggtaaccgtcgggtacccgtttacgttaacgttgtttacgggtgttaaggtagttaccgttagggtcggtcggtagtgggtacgttgggtactacggtacgtanacccggtagggtccggggtacccggg

SEQ ID NO: 44876 - DNA, 830 bp, Homo sapiens
  misc_feature: GYAE6OF01AK7BQ.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcaggaggtgtccagtgtgaggtgcaacgtgggtggagacgtgggcggaggcgttggccaggtccgtggggcgttctcgtaggacgtacttcggtccttggtacgtaacccgttcggtcggggtccttcccggtcgacgccgacggccgtacgttgttacgtttcggcccgttcgggggtccccgaccgacggtccgtaccgggaaggggaaacgggtacgggtccggggtaagggtcggggtcgtaccggttaaggttttaagttttttaacggacggggttacggggaaccgtaacgttaacgtttacccgtaacgggtaacgtaccgttccggaaggttcggggaacggggtacccgttaacgtttacccaacccgtaacgttcccgttaccggaaggtaccgtttaacctttttccgaaccgtaaaggtaaaccctacgtaccgtttacttcccgtttaccttaacaaaacttcggaaacccgtcggaccgttacgggaacgggtcccgaaacgggtcccgtaaccggggttcctttaacgttagtttacggttggtcgtaggtacgtttacgttaggtcggtacggtggttcggtacggttcgggtacgaacgtcggacgttaccggtcgggtcggggtacccgtaacccgggg

SEQ ID NO: 44877 - DNA, 750 bp, Homo sapiens
  misc_feature: GYAE6OF01EIYHT.19.67.G01.1.454.CMB.1.raw
  modified_base (458)..(458): a, c, t, g, unknown or other
  misc_feature (458)..(458): n is a, c, g, or t
  modified_base (529)..(529): a, c, t, g, unknown or other
  misc_feature (529)..(529): n is a, c, g, or t
  modified_base (560)..(560): a, c, t, g, unknown or other
  misc_feature (560)..(560): n is a, c, g, or t
tcagtactctcgtgcacgaccggtgctcgatttagagtatacatattgggtttggggggagaggagcccagcacgtgggattccgaggtgtttccattcggtgctcagcactgaacacagagactcacatggagtttgctgtccgttcgggttttccttgcctgtactaatttcgaggagtcgtccgaggttggtgacggtcgactaacgtgggacggaagtcggtgggcgggtagtcgttcggtaccgacggtccggtcgggcggttacctgtaggtaacgtccggtcgtccgttcggtaccgtaaccccgttggtacgggttcctccgtagacgtcgacgtcgtacttgtacgtgcccggtcggtcgccgcggccgtacgagggacggacggtccgggagtcggtacgagttaagtttattttacgggagggtcgacgtaactagtcccgtaaggntacccgttgaaggcggtagggaccttagccagtctaccgacgtaagttcttatttccgactaacaaccgtnttaacctgttaccttaatacaaacgtgtacnccgacggtcgaacggtccggaacggcccgtaacgggtcccttatttacgttagggtaccgtactaagggtttccgtaaaggttggttacggaccggtagggttacccgggtattcgggggaaaccgtttaaacgacgggtttaccgttaaccggggcccggggtttaagggtaccccggttaaacccggg

SEQ ID NO: 44878 - DNA, 690 bp, Homo sapiens
  misc_feature: GYAE6OF01AW0IR.19.67.G01.1.454.CMB.1.raw
  modified_base (192)..(192): a, c, t, g, unknown or other
  misc_feature (192)..(192): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
tcagtactctcgtgcacgaccggtgctcgatttagagtatacatattggggtttggggggggagaggagcccagcactgggattccgaggtgtttccattcggtgctcagcactgaacacagaggactcaccatggagttttggctgacctggttttcctgctgcaatttcaggagtgtccagtgtgaggtnacaacgtggtcgagacgtggcggaggcttggccagccgtgggcgtctcgtgagtctgtctgcgacctgtggtctcgtnagcagcgatgtactcgccgtcgggccncgacgctacggagggaacgacggtccggaggtcgggtcgacgtaggtttagttttaggngggtagggaccagtatttaccggaacggtacaccgtcggtagtcgggggacggcctaacttaccaccgtacttccgtaccgagtacgttactttcgacactaacacctatcgtaccttacttaanaaacgtcgaactcgtaccgnggtaaccgggctacgggaaccgtacccgggttccgttaagttacgtttacttagggtccgttaggtaggtttaaacgttacgggtacgggtacggtacggttacggcgggtttacgggtaaggtaacgttaacgggtacccggtacccgggtaacggggtcccggggggtaacccgtaaaccccggggg

SEQ ID NO: 44879 - DNA, 765 bp, Homo sapiens
  misc_feature: GYAE6OF01CC2DQ.19.67.G01.1.454.CMB.1.raw
tcagtactctcgtgcacgaccggtgctcgatttagagtatacatattggggtttggggagagggagcccagcactgggattccgaggtgtttccattcggtgctcagcactgaacacagaggactcaccatggtagttttggctgtaccttgggttttccttgctgctaatttcgaggagtgtccgagtgtgaggtgctaacgtgggtggacgacgtgggcggaggtcgttcggtccagtccggtggggtccggttctcgtaggacgtcttggtcctggtaccgtaacccgttcggtcggggtccttccggtcgacgtcgacgcgtacgtgttacgttcggccgtcgggtcccgaccgacggtccgtaccggaggggaacggacgggccgggtagggtcgggtcgtacgttaaggtttagttttaaggtagggtacgggacgtactagttacgtacggtacgacgtacgtaggtacgggacggccgtaactccacctactctaccgtagtacttactttcagaactaacactacttcgtacgttactacgtaaacgtacgaacgtacgtacgtacgggaacgggaccggtaacggacccggtaccgggttaccgtttaacgttaacgtttaggttcggttacggtaagggttacggttaggtttaaccggtagggtacggttaggtacggggttcggttacggggtaggtaccgtaaggtaccgtacggtcggggttacccgggggtaacccgtaaacccggggg

SEQ ID NO: 44880 - DNA, 793 bp, Homo sapiens
  misc_feature: GYAE6OF01B4V8H.19.67.G01.1.454.CMB.1.raw
  modified_base (177)..(177): a, c, t, g, unknown or other
  misc_feature (177)..(177): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccttgggttttcctgctgctaattcaggnggtgtccagtgtgaggtgacgtaacgtgggtggagacgtgggcggaggtcttgggtcccaggtcccgtggggtaccgtcgtccgtaggacgtaccttggtcccttacgtaccggtaaccccgttcggttcggggtccctccggtacgcgcgacgtcggtacgttggtacttcggtccggttcgggggtcccaccggtacggtcccgtacgggaaggggaacggacggggaccgggtaagggtcggggtacccgtggttaaagggttttacgttttaaggtacgggttacgggaaaccgtcgtaactttccgggtaacggacgtacctaccggaggttcgggaacggggtcctaacgtccctaaccgtcgtacctaccgtaacgtacgtttaccgttttccgaaacgtacgtaacgtaaccctacgttaccgttactcctttaaccgaagtaccgaacgtacgtacggtacgggcggtaccggacgggtaaccgtaccggtacgttacttaaggttcgttacggtagtacggtaacggttaggtttacgggacggtacggttcggtcgggtaagttcggggtaacgacgtaggtcgaccgggttcgggtaaccgggg

SEQ ID NO: 44881 - DNA, 841 bp, Homo sapiens
  misc_feature: GYAE6OF01BVNRE.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccagtggtagttttggctgaccttggttttccttgctgctaatttcaggaggtgtcagtgtgaggtgctaacgtggtaggagacgtgggcggaggtcgttggtccacgccgtggggcgttctacgtggacgtacgttcgtcctggtaccgtaaccccgttcggttccggggttccttcccgtacgacgccgacgccgtaacgtgttacgttcggtcccgttcggggtacccgaccggacggtccgtaccggaacggggtaacggacgggaccgggtagggttcgggtccggtacggttagttttaagtttttacggtagggtcggtaacgtacttacgttacgtaacgggagtaaccgttcgacggttcgggaccggtacgtaacttccgaaccgtacgttaccgtaccgaaacggttacgtttaccttttaccgaacgtaaaccggtaaacctaccgtacggtttaacttccctttaacgtaacgtaaaaccgtacggaaaccgtaccggtacccgtaaggggacccggggtaaacccgggacggtaaccccgggttaccgggtacccgtttacgtttagttttaacggttcggtacgggtttacggtaaagttttaacgggtttagtcgggtaaccggttggttccgggtcgggttaacgggacggtaactaaggttaccggtacgtaccggggtcccgggtaaacccgggg

SEQ ID NO: 44882 - DNA, 737 bp, Homo sapiens
  misc_feature: GYAE6OF01EF1FH.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccttgggttttcctgctgctaatttcgaggtaggtgtccagtgtggaggtgcctaagtgggtggagacgtgggcggagtcttggccagccgtgggcgtctcgtgagtactcgtcctgtacgtacccgtcgtcggggtcctccgtcacgcagcgtactgtacttcggcgtcggtccgccgacggccgtaccggaagggaggacgggcgggtaggtcgggtcgtacgtaggtttagttttaggtaggtgggacgtactagttcgtacggtagacgtccgtaggtacgggacggaccgtattcccgactacgtaccgtaccgtaacgtacgtttaccttttaccgtacgaacgtaactaccttactttacgttaccttaccgttaactaaaccgttacgaacccgtgtacccggttgggaaccggggtacccggacgggtacccgtacgggttacccgtttaagttacggtttacggtttaggtgtttaaaggtacgttttaagggtttaacgacgggttaccggttggttaccgggttcgtacggggttagaaccgtaagttaccggtcgtacccgggtaaccccgggggg

SEQ ID NO: 44883 - DNA, 696 bp, Homo sapiens
  misc_feature: GYAE6OF01B8MQO.19.67.G01.1.454.CMB.1.raw
  modified_base (337)..(337): a, c, t, g, unknown or other
  misc_feature (337)..(337): n is a, c, g, or t
  modified_base (433)..(433): a, c, t, g, unknown or other
  misc_feature (433)..(433): n is a, c, g, or t
  modified_base (632)..(632): a, c, t, g, unknown or other
  misc_feature (632)..(632): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccagtgggtttgctgacctgggttttcctgctgctaatttcaggtagtcgtccagtgtgacggtgctaacgtgggtggagtacgtgggacggtgctttgggtccaggccgtggggccggttctaccgtgaagtctcggtacctggtaccgaacccgtgttcggggtctccgtcgacgcgagcgacgtgttactcggccgttacgggtccncgacggcctacgagggtaacggcggcggtaggtcggtcgacgtaggttattttaggaggtcggactacgtagtttacgacggataccgtcgtaggnggtacggacctcgttacgacctagtccgtaacgacgttacttacgttttcacgaacgtaacctacctacgttcttaccttacttaacgaaacttacgaacgtaccgtaccgggtaacgggaccgggtacgaacggacccgtaccggtcgttactttagttacgttggtacgtggtacgttaggttacgacggttacggnttacgggtgtacgggtacggtactaacggcgttaacggacggttcggggacccgttaaccgggg

SEQ ID NO: 44884 - DNA, 664 bp, Homo sapiens
  misc_feature: GYAE6OF01AO0XV.19.67.G01.1.454.CMB.1.raw
  modified_base (195)..(195): a, c, t, g, unknown or other
  misc_feature (195)..(195): n is a, c, g, or t
  modified_base (339)..(339): a, c, t, g, unknown or other
  misc_feature (339)..(339): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccttgggttttcctgctgctaatttcaggagtgtccagtgtgaggtncaacgtggtggagacgtgggcggaggtcgttggtcccaggtcccgtggggccggtctacgtggacgtactcggtcctgtcgtaacccgttcgtcggggtcctccggtcagcgagcgactgtacgttcgccgtcgggtccgccgnggccgtccggaagggaggacgggcggacgggttgggtcgacgtaggtttaatttttaggtagggtggaacgtacgtagttacgtacggacgtacctacgacgtcgggacggtccgtacttcgacctactcctaccgagtacgttacttttacacgtaacgtaaccactacttcgttacttacttacaatacgactacgccggtgggacggcgaaccggtaccgaccggtcgttacttgttagttcggtgttacggaggttagttaggtacggtggtgttcgggtcgttgggtacggtacgtaagacgtccggcgggtacccgggg

SEQ ID NO: 44885 - DNA, 792 bp, Homo sapiens
  misc_feature: GYAE6OF01AVNS1.19.67.G01.1.454.CMB.1.raw
  modified_base (248)..(248): a, c, t, g, unknown or other
  misc_feature (248)..(248): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctggcgggacatcgtgatgacccagtacccagacctcacgtggctgtgtccgtcgtgggccgaggaccggccaactaagtacaactcgacaggtccagaccaagaacttcttcnccaacctacaaagaactaaacttctacgcctagtaaccagagacgacgaggacacgtacctacgtaaggtcgtactactagtttacggtcggtactactacgacgtaacgtacggtttccgggacctacgaccggtacggtccgggactacgggcgggttacgtagggaactacggttactttacccgaccgttacctaccgaacccgtaagtacccgtaaggtcccgtaacgggtcccctaaggggtaacccgtaacggggtaaccgttaaacgggtaaagtaccgggtttacgggttaacgggttaaccggttttaaaggttttaccctttaaacgggtacggtaactaaccgttaaaccgttttaagttttttacctttaccgttaccgttaccccgggttaggtaccggggtttaacctacccgggaacggggttaacgggacccggtaaggggtttaacaaacgttcggaacgttaacggtaacgttacgggacgttacacgggtaaccctagttaaacctcgttccttactaccccgg

SEQ ID NO: 44886 - DNA, 880 bp, Homo sapiens
  misc_feature: GYAE6OF01CUG3K.19.67.G01.1.454.CMB.1.raw
  modified_base (185)..(185): a, c, t, g, unknown or other
  misc_feature (185)..(185): n is a, c, g, or t
  modified_base (782)..(782): a, c, t, g, unknown or other
  misc_feature (782)..(782): n is a, c, g, or t
  modified_base (793)..(793): a, c, t, g, unknown or other
  misc_feature (793)..(793): n is a, c, g, or t
  modified_base (828)..(828): a, c, t, g, unknown or other
  misc_feature (828)..(828): n is a, c, g, or t
  modified_base (835)..(835): a, c, t, g, unknown or other
  misc_feature (835)..(835): n is a, c, g, or t
tcagtactctcgtgcacgaccggtgctcgatttagagtatacatagttgggtttggggggggagaggagcccagcactgggattccgaggtgtttccattcggtgctcagcactgaacacagaggactcaccagtggtagttttggctgtaccgtttgggttttcctgctgctaatttcgagggnggttgtaccgtaggtggtggaaggttggtaacggttgggtagggacgtacggtcggggacgggtacgggttcgtttacgggccgtacgggttccggttacgggggtccggtttccgtacggtacggtaacggtaccgtttcgggttacccgttcgggttaccgtaaccccggtttcgggttacccggggggttacccttcccggtacggaaccggtccgtaaggtacccggttacggtttaggttaccgtttccccgggtccgggttacccgggggttacccgtccgggaccggtacccggtaacccgggaaaggggtaccgggaaaacgggggtccggtaacggggttcggtacgtacggttaagggtttttatttacggggagggtacggtaacgtacttaggtttaccggaacgggacgtaaccgtccgtagggtaccgggtacggtacctcggttaaccaccgttactccgtaacgacggttactttaccgttaccgtaccgaaactaaacgtcctaagtttccttacgttacgttaaaccgtactaacgacgtaccgcggtaagccgggtacgaggtacccgagtaccgttntacgtgttagngggttacagttagtcggagttccggagtcgggttnaacgggngactacggtacggtcgtaggggccggaacggtacccggtacccgg

SEQ ID NO: 44887 - DNA, 819 bp, Homo sapiens
  misc_feature: GYAE6OF01C36J6.19.67.G01.1.454.CMB.1.raw
tcagtactctcgtgcacgaccggtgctcgatttagagtatacatattggggtttggggggagaggagcccagcactgggattccgaggtgtttccattcggtgctcagcactgaacacagaggactcaccatggagttttggctgaccttgggttttccttgctgctaattttcaggagtgtccagtgtgaggtgcaacgtggtcggagactggcggaggcttggtccagcctgggcggtctcgtgagactgtcctgtcgaaccttgtcgggtcctccgtcgagcagcgtactgtacgttcgccgtcggtccgccaggcctaccgagggaaggacgggccggaggtcgggtacgacgtaggtttatttttaacggagggttacgggactaacgtacgtttacggaacgggtacgtaccttaccgaggttcgggggacggtacccggtaatttcccgtaaccgtattccctacccgtaagtacggtttaccgttttttaccacggtaaacgtaaccaacgttaccgttccgttaccttacgttaacctaaaacgttacggtaaacctaacgggtacccgttaacgggtaaccggggaacccggtaaccggggtaacccggtacccggggttacccgtttaacgtttaaacggttttaccggttttaggttcgggtttaacggttaaacggggtttacgttttacgggtacggggttacgggttaacggtttcggggtcgggtttacggggttaacggtaaacgtacggttaacgttacgggtaacccgggttcgggggaccccgggttaaaacccggggg

SEQ ID NO: 44888 - DNA, 913 bp, Homo sapiens
  misc_feature: GYAE6OF01CS9YX.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatgacccagtaccagactcactggctgtgtctcgtgggcgagaccggccaacaatccaaactgaccaggtccacgccaagtaaacctattttcctacccaacccttaccgaaaacgtaaaacctaaaaaactttccgttaacgcccgttagggtaaacccaaaagacgaacgaaccaagggaacaacggtaccccttaaccgttaaaggttcgaccctttaccgtaaacgttttttaccggtggggtacccttttaccgtaacccggaccggtacggttaaaaccgttttcccggggggttaccccttaacgggtaaccccgggtaacggtttccccgggggggaacctaacggggtccgggggtttaccgtaagggggaacctaggtactttttacccgaccttacctaccgaacctactacgacgacctaacgtcccgtaggacccgtaagggtactaacgggtaacgtagttacggggttcgggtacgtttaaacgttttttaacttaacggttcgttaaccgaagggtttaaccttaaaacgttttttacgtttttttttacccttaaccgtttaccccggttcgggtttaaccgggggttaaccggttttacccgggtaaacccggaaaaccgggggtaaccccggtaaggggggttaaacggtaaaaaccgttccgaaaacgggttaaccgggtaaacccgtagggtttccggaccgttaccgaaccctaacgtcggttaccgttttaccg

SEQ ID NO: 44889 - DNA, 854 bp, Homo sapiens
  misc_feature: GYAE6OF01C5XUA.19.67.G01.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttccttgctgctaatttcgaggaggtntaccagtgtggaggtnactaacgtgggtggagacgtggggcgggtaggtcgttcggtccacggtccggtggggtccggttctcgtaggacgtacttcggtccgtggtaccgaacccgttcggttcgggggttaccttcccggtgacggcgacggccgtacgttacggttacgttcggccggttcggggtaccccgccggtaggcccgtacgggaacgggggaaacgggcggggaccgggtagggttccggggtacgtacggttaggttttaaggtttttaacgggaggggttacggaaccgttacgttaacgtttacggtaacgggacgtaccgtaccgaagggttaccgggggacgggtaccttacgttaaccaacttacgttacctacggtaacgttaccggttttaccgttttacaacgtaaaccggaacctacgttaacgttcgttaacccttacgttaacctaaagtaccgaacgtacggtacccggtagggtaccggggtaacccgaacgggtacccggtaccggttaccgttaacgtttacgtttacgttggttaacggttaggttacggttacgtttacgggcgggttacgagggttacggtcggttagggtacggacgtaacggtacgtacgggaccgggtcgggggtacccgttaaccggg

SEQ ID NO: 44890 - DNA, 831 bp, Homo sapiens
  misc_feature: GYAE6OF01BQNNH.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccagtggtagttttggctgtaccttgggtttttccttgctgactaattttcgagggtaggtgtccgaggttggtacggagggttcgaccgtaacgttgggtgggaagtcggtgggccgggaggtcgttcggccgagtccggtggggtcgtctacgtggaacgtcgtgtccgtgtacgtaaccgttcgtcggggttcctccggttcacgcacgcggtactgtacttcggccgttggggtcccgccggtacggccgtaccggtaacgggacgggaccgggcggtacgggtcgggtcggtacgttaaggtttacgtttaggtacgggtcggaacgtacgttacgttacggtacggtacgtacgtaccgtaggtacggggacggtaccggttacgttacccgaaccttacgtaccgtacccgttaggttaccgtttaccttccgtaacgaacgtaacctaccgtacgtttcgttaccgttacttacgtaaacgtacgaaccgtcgtaacggtcgggacggtaaccgggaaccgggtccgttaacggttcccggtttaacgtttagtttacggttcgggttaggttacgttaacgggtttacgttttaaggggtccgttaaaggttcgggttaccgggttacgggttcggggtaaccgtaggtaacggttttacccgggtaaccggttcggggtaaaccccggggg

SEQ ID NO: 44891 - DNA, 822 bp, Homo sapiens
  misc_feature: GYAE6OF01BOFK8.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttcctgctgctaattcgaggaggtgtccagtgtgaggtgctaacgtgggtggagacgtgggcgggagtcgttcggtccgagtccggtgggcggttctcgtgagtacgtgtccgtgtaccgaccgtcgtcgggtcctccgtgacgcgacgtcgtagttgtacgtcggccggttcgggtcccgacggacggtaccgtaccggaagggacggacgggtccggtagggtcgggtcgtaacgttaggtttaatttaggtacgggtacggacgtacgttacgtttccgaacggtacgtaccgtacgtaggtacgggtacggtaccgttacttacccgaccgtacttccgaccgtaagttaccttacgtttacaccggaactaaacctaccgttaacgttcgtccgtttacttaacgtaaacgtacggtaaccgtacgggtccgtaacgggaccgggtaacccgtaacgggaccccgtaaccgggttaccggtttaaccgtttagttttacgggttacgggtttacggaaggttaacgggtttaacggtttacgggtacgggtacggtttacgggtaggggttcccgggttacgggtaacgggtaactacggggtaaacttaccccgggggtaaccgttcccggggggtaacccggttaaaacccccgggggg

SEQ ID NO: 44892 - DNA, 795 bp, Homo sapiens
  misc_feature: GYAE6OF01CVPYY.19.67.G01.1.454.CMB.1.raw
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (725)..(725): a, c, t, g, unknown or other
  misc_feature (725)..(725): n is a, c, g, or t
tcagtactctcgtgcacgaccggtgctcgatttagagtatacatattggggtttggggggagaggagcccagcacgtgggattccgaggtgtttccagttcggtgctcagcactgaacacagagactcaccagtggtgtttggctgtaccgttggttttcctgctgctaatttcgaggtacgtgtccaggtgtggaggtcgacgacgtgggcggagacgtgggacggngtccgttggacctacggccgtgggtccgttncgtaggtacgcgtcggttacctcggtaccgtaccgttcggtcgggttcctcggtacgacgacgtagaccgtgttcgttacgttccgaccgggtttcggacccgaccgtcggtaccgacgggaaaggggacgggccgggtaccgggtagggttcgggtacgtacggtttaaggtttagttttacgggagggtacggtactaacttagttccggaacggtactacccgacggaggtacgggaccgtacgtacttaccgaccctagttcctaaccggtagttaccgtttactttacgaacccgaacgtaccctaattcgtaccgttacctactaacgttaacgacttaccgtacggaccggtagggaaccggtaaccgggtaacgtacccggtcggttacccggtttaattacgggtttaacttgggaacgttagggttacgggttaaggttccggaacgggtggttanacgggggttctaaggggtacgtaacgtcggttaaccggacggtaccggggtacgggtaacccggtaccgg

SEQ ID NO: 44893 - DNA, 747 bp, Homo sapiens
  misc_feature: GYAE6OF01ET00G.19.67.G01.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
tcagtactctcgtgcacgaccggtgctcgatttagagtatacatagttgggtttgggggggagaggagcccagcactgggattccgaggtgtttccattcggtgctcagcactgaacacagagactcaccagtggtagtttggctgaccgttgggttttcctgctgctaatttcgaggtagtgtccaggtgngaggtncagtggtgagcgtggcggtagtcttaggccaggtccgtgggtccgttctccgtggaacgtcgttcgtccgtaggtaccgtaaccggtcggttaccgggtcctccgtacgaggccgtacgtacggtacgttacggttacgttccggtaccggttccgggtacccgaccgggtacggtacccgtaccgggaaggggtaaccggccggggtaccgggtaaggttccgggacgttaacggtttaggttttaacgtttagggtacggggtccgggtaaactacgtaacggtttacggaaccggacgtacgtacgtacggtacgggggtaccgaccgttataccggtaacctcgtaccgtacgtacgttacgttacgtttcaacgacgtaaccacgttacttcgtaaccttactaagaacgtacgaacgtccgagtacggacggtacgacgaccgtaccgtcttagttattgtaagtgtaacgtgttagttcgacggttcgaggttccggattcggggataacggtcgtagaacgtcgggtacggtcgtacccgg

SEQ ID NO: 44894 - DNA, 959 bp, Homo sapiens
  misc_feature: GYAE6OF01D1YSN.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagagactcaccatggagttttggctgaccttgggttttccttgctgactaatttcgaggtaggttgtccgtagtggtggaggtgacgtaacgtgggtaggagtacgtgggcgggtaggtcttacggtcctaggtccgtggggtcggttactgtggacgtacgtcgtccgtggtacggaacccgttggttcgggggttcccttaccggtaccacgggtacctaggtaccgttaacgttggtttacgtttccggtcccgggttcgggggttaccccggcccggaacgggtcccggtacccgggaaagggggtaaccgggacggggtacccggggtagggttacgggggttccgtaacggtttaagggtttttaagtttttaacggggacgggggttacggggtaaacccgtacggttaacgttttaaccgggaaccgggtaaacgttacccgttaacccggtaagggggttaccggggaaccggggtaccttaacgtttaaccccgaaccgtaccgttacccgtaccgtaacggttacggtttaacccgtttttaaccgtaaccgttaaacggtaaaccttaaccgtaaccgtttaccgtttaccgttaaccttaaaccgtaacggtaacgtaaccgtacggtaacggtacgggaaccggggttaccgggaacgggtaaccggtaacccgggttaccgtttaacttacgtttacgttacgggttaggtaggttaacggtttagggtttaaacggtcgggttagggtcgtttacgggggtacgttacggggttaccggtaacggttaacggtaccgttccgggaccggggttaaacccgggg

SEQ ID NO: 44895 - DNA, 810 bp, Homo sapiens
  misc_feature: GYAE6OF01BQZ25.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgctaatttcgaggtaggtgtccagtgtgaggtgcaacgttgggtggagacgtgggcgggaggcgttggtccgaggtccgtgggcgttctctggacgtacgtcgttccgtgtaccgtacccgtcgtcggggtcctccgtcgacgcgacgcgtacttgtagttcggtccgtcgggtcccgcgtacggtccgtaccggaggggaacggacgggccgggtaggtcgggtacgtacgttaggttttaacgttttaaggtagggttacggggaacgtaaccgtaagtttccggtaaaccgggtacgtacccgttaccggtaggtacgggggacggtaacccgttacgttacccgaccgttaacgttacccgtacgtaacggttacctttaaccgttttccaacgaaacggtaaccctaacgtacgtttacccggttctttaacccttaacgtaaaacgtccgtaaaccgtccggtaaccgtacgggaaccgggtacccggaacggacccggtaccgggtacccgttacgtttaagttaccgttggtaacgggttagtaacggtttaagttcggtagggtacgtagggttcgggtcggttaggtacccggtagtacgtacgtaccggtacgggtccgggaaccggtaacccggg

SEQ ID NO: 44896 - DNA, 759 bp, Homo sapiens
  misc_feature: GYAE6OF01E354A.19.67.G01.1.454.CMB.1.raw
  modified_base (60)..(60): a, c, t, g, unknown or other
  misc_feature (60)..(60): n is a, c, g, or t
  modified_base (142)..(142): a, c, t, g, unknown or other
  misc_feature (142)..(142): n is a, c, g, or t
tcagtactctcgtgcacgaccggtgctcgatttagagtatacatattgggtttggggganctacaacaggcaggcaggggcagcaagatggtgttgcagacccaggtcttcatttctctgttgctctggatctctggttccnggcgggacatcgtgatacgaccctagtacccagcctcacgtggtctgtgtctcgtgggcgaggaccgcaacactccaactcgcgtacggtccagaccctaagtaaccttcttttacccaccctaaccctaaccgaaaagtaaaaacccttaaaacctttccgttaacgcccggttaacggtaaccctaaacgagaaccgaaccggaggaacctaccgtccccttagttaaacgttcgaccttagtttacgtttacggccgggttaccttacgtacccggcgtaccggtacgggttcccggtaccctacggaccggtcgggtcgggctacggggtcggaacggttacggacttacggttaccttacgtacctccgttaaccgactacgtaccgacggaccacggtcccgtagcccggttaagggctaagggtaacacgggtttcggacgttagtttaaggtttaccctagttcgagtacttacgtttaatttcgtttaccctcggttccgttacggtcggtacccggtaacggccgggaaccgggttaacggaggtttacggaccgtagaacggtccgtatcgggccgttacgaccttccggaacttcgtacttcccg

SEQ ID NO: 44897 - DNA, 756 bp, Homo sapiens
  misc_feature: GYAE6OF01AD1BJ.19.67.G01.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccagtggtacgttttggctgaccgttgggttttcctgctgctaatttcgaggagtgtccagtgtgnggtnctaacgtggtggagacgtggcggagtcttggaccaggccgtgggcgtctcgagacgtacttcgtcctagtccgaaccgtcggtcgggtcctccgtcgagcgacggtctacgttgtacgttcggaccgttcgggtcccgccggtacgtccgtaccggaagggaacggaccgggcgggtaggtcggtcgacgttaggttttaagttttaggacgggttgggaacctacgtacgtttacggaacggtaacgtaccctcggaggtacgggacggttaccgtacttaccgaccttactccgtaccgaacgttaaccggtttctttaccacgtaaacgtacctaaccgtcttaccgttccttaacgttaacaaagttacccgaggaaccgtcgaaccggggacctaccgggtaccggaaccggtaccgttcccgttaagtttacggtttacgttagtcggttaaggtaccggtttaaggttcgaggtaccggttagttcgggtacggttggtacgaacgttgacccgtttacggaccgggttagggtaccccggtaaccgggg

SEQ ID NO: 44898 - DNA, 722 bp, Homo sapiens
  misc_feature: GYAE6OF01BWLSH.19.67.G01.1.454.CMB.1.raw
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
tcagtactctcgtgcacgaccggtgctcgatttagagtatacatattggggtttgggggggagaggagcccagcactgggattccgaggtgtttccattcggtgctcagcactgaacacagagactcacagtggtagttttggctgtaccttgggttttcctgctgctaattgaggtgtcgtcagtgtgaggtnacaagtggagagtacgtgggcgagtccgttggtaccgaggtccgtggggtcgttctacgtgtacgtacgttcggtccgtggtaccgtaaccccgttggtcgggttcctcccggtagacgnacggtaccgtagtagttacgtcgtacccggtcgggtccgccgtacgggtccgtaccggaagggaacggacgggtcgggtacggtggtacgtaggtttacgtttaagttttaggacgggttacggaacgtactaacgttaccggtaaggacgtacctacgacggtagggacggtccgtaatccaacctacttaccgtacgtagtacgttacgttttacaacgtaacgtaaactacacgttctacttacgttaacaaagtacgaacgtcgtacgtacggacggaacgaaccgtacggaccggtacttagtttactttaggtacgttgtaacgttaggttagttacggtaggtacgtggtacggttaggtggtaacgagtacgacgtagaacggtcgggccggtaaccggg

SEQ ID NO: 44899 - DNA, 941 bp, Homo sapiens
  misc_feature: GYAE6OF01EESAQ.19.67.G01.1.454.CMB.1.raw
  modified_base (102)..(102): a, c, t, g, unknown or other
  misc_feature (102)..(102): n is a, c, g, or t
tcagtactctcgtgcacgaccggtgctcgatttagagtatacatattgggtttggggggagaggagcccagcactgggattccgaggtgtttccattcggtnctcagcactgaacacagagactcacagtggtgtttggctgtacgttgggttttcctgctgtactaatttcgaggaggttcgtcctaggttggtgtagggttgacgtaacgttcggggtaggtacgtacggttcggggcgggtaacggttccgtttcgggtacccgacgggtcccggtcggggtccgttccgtcgtggtaacgtcgttacgtcgttacggtaccgtaacccgttcggttcgggtcccttcgtcgagcaggctagttgtcgtcgccgttcggaccgcgtacggccgtaccggaaggggaccggacggggccggtgggtacggtcgtaggtttaaggttttaatttgtaagggttcacggttaacttgtaccgtaacgggaccttcgtccggtaaggtccgggtacggtaacccgttacgttaaccgacttacgtaccccgtacggtaacgttccgtttaaccggtttcaacccgaaaacgtaacccttaacgggttacccttttaccggttaacccttaccgttaaaacgttaaccgttacgggaaaaccccgtccgggtttacccggaacgggggtaaacccgggtccccgggtaaacgggttaacccccgggtaccgggtttacccgttttaaaaccgggtttttattttacccggggtttaacgggttaccggtttacggggttaacgggttttaaactttccgggggtaagttacccggttaagggttccggggttaacggtttccgggggtaaaccgacgttaaacgggtttacggacccggggtttaacccgggcccgggggtaaaccccgggttaaacccgggg

SEQ ID NO: 44900 - DNA, 493 bp, Homo sapiens
  misc_feature: GYAE6OF02I3EED.19.67.G01.1.454.CMB.1.raw
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
  modified_base (491)..(493): a, c, t, g, unknown or other
  misc_feature (491)..(493): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttcncagaacacactgtctcttcaaatgaacagcctgagggccgaggacacggccgtctattattgtgtgagagtttatggcgatggctggtggacagatcactggggccagggaaccctggtcaccgtntcctcagcctcacaggcccatcgtctccctgcnccctgctcagncactcgngngcanagcgcctgggctgcctggtcaaggctactccagagagtacngagcgggctggcaaggcgcagagnnn

SEQ ID NO: 44901 - DNA, 540 bp, Homo sapiens
  misc_feature: GYAE6OF02HK3BN.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggagaggccggagtgggtcgcagggtattttagtagggtgggacgacattctacggagactccatggagggccgattcaccatctccagagtacttttctcagaacacactgtctcttacaaatgaacagcctagacgggccgaggaccacggccgtactattattgtgtgagtagtttatggcgatgggcttgggtggacgaggatcgacgttcggggacctaaccgggg

SEQ ID NO: 44902 - DNA, 506 bp, Homo sapiens
  misc_feature: GYAE6OF02FQHE8.19.67.G01.1.454.CMB.1.raw
  modified_base (238)..(238): a, c, t, g, unknown or other
  misc_feature (238)..(238): n is a, c, g, or t
  modified_base (501)..(501): a, c, t, g, unknown or other
  misc_feature (501)..(501): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctcaagaacaaaaacttcttagcctggtaccaacagagaccaggacagcctcctaagttgctcatttactgggcttctacgcgcgaattcggggtcctgaccgattccggggcagcgggtctgggacagatttcactctcaccatcagcagcctgcaggctgaagatgtggcagtttatactgtcagctaattatttttcttattcctcgtgacgttcggcaagggccagggtagaaatcagacgtactgtgctgcacntctcg

SEQ ID NO: 44903 - DNA, 665 bp, Homo sapiens
  misc_feature: GYAE6OF02HWD8G.19.67.G01.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (401)..(401): a, c, t, g, unknown or other
  misc_feature (401)..(401): n is a, c, g, or t
  modified_base (501)..(501): a, c, t, g, unknown or other
  misc_feature (501)..(501): n is a, c, g, or t
tcagtactctcgtgcacgaccggtgctcgatttagagtatacatattgggtttgggaacaacacggacaggcagggtccagcaagatcggtggttgcagacccaggtcttcatttctctgttgcttctgggatctcttggttcctgcgggacatcgtgactggacccagtacccagacgtcacgttgggctgtagtctcggtgggcgaggacggaccacaactcgaactgcgaggttcccagccaagaacgtnttttccnccgacttccaaagtaaccaaaacttacttagccttagtaacctaacgaggacgaccgaaggaccgacgaccctaccgtaagttcgcgtacgtaggtttacgtgggcttcgtacgccgagaacgttcggggccctagaccgngttccggctacgcggtcgtgggacagactttacacgttctacgaccatccacgacacgtacctgaccgacggtctagaagtgttggagcttacggtttancgttagtacagaacgtaactttacgtttttacttacttcccgttacggttggtaccgttacgggacgtaacgggtaccgtagggttacgtaacgtcgaaacggtaccgtaagttcggtacggtccgtacgtaccgtaccgtaggtccggttcgttaccgtacgg

SEQ ID NO: 44904 - DNA, 845 bp, Homo sapiens
  misc_feature: GYAE6OF02IC0BG.19.67.G01.1.454.CMB.1.raw
  modified_base (392)..(392): a, c, t, g, unknown or other
  misc_feature (392)..(392): n is a, c, g, or t
tcagtactctcgtgcacgaccggtgctcgatttagagtatacataagtttgggggtttggggagaggagcccagcacgtgggattccgaggtgtttccgattcggtgcgtccagcactgaacacgagacggactcaccatgggagttttggctgacctgggttttaccttggctgctaactttcgaggtaggtcgtccagtcgtgacggtcgcaactggtggagactgggcgggaggcttggtccagccctgggcggtcgtcgtcgggacgaacgtcgtccgtgttacgaaccttgtaggggtcctaccggttataggcagcgactagtaactggaccctagggtccccaccgaggtcctccgaagggtagtacgggccggagtcgggtacncgttaggttattttaaggacgggtacgaaacgtacgtaagttttcgaacgggtaggacttaccgaagttcggggaacgggtcccggtaatttaccgaaacctttacgtaccctttaccgaacggtaaacgttaccgttttttaccaaccgtaacggtaaacctaaccgtaaccgttacgggtttccttaaccggtttaaccttaaaaacgttttcgggaaaacccttaacggtaacccgttagggaacggggttaccccgaaagggggtaacccgtaaccggggttacccggtttaccgttaaccgtttacggttacggttacggttacgggtaacgggttaacgggtttaacgttacggggacggtaacgttacgggaaccggtttagggtaacgggtacgtaacgggtaccgttacccggtaccggttaccgggggacccgtaaaccgggg

SEQ ID NO: 44905 - DNA, 542 bp, Homo sapiens
  misc_feature: GYAE6OF02ITXBE.19.67.G01.1.454.CMB.1.raw
  modified_base (410)..(410): a, c, t, g, unknown or other
  misc_feature (410)..(410): n is a, c, g, or t
  modified_base (463)..(463): a, c, t, g, unknown or other
  misc_feature (463)..(463): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttagtaggtggacgacattcgtacggagactccatggacgggccgattcaccatctccagagacttttcncagaacacactgcttctcaaatgaacagcctgacggccgaggacacggccgtntattatcgtgtgagtagtttagtgggcgtagtcgggcttagggtagggtaccaaggactcgtacgtgggggtaaccccg

SEQ ID NO: 44906 - DNA, 517 bp, Homo sapiens
  misc_feature: GYAE6OF02GCRKF.19.67.G01.1.454.CMB.1.raw
  modified_base (238)..(238): a, c, t, g, unknown or other
  misc_feature (238)..(238): n is a, c, g, or t
  modified_base (439)..(439): a, c, t, g, unknown or other
  misc_feature (439)..(439): n is a, c, g, or t
  modified_base (514)..(514): a, c, t, g, unknown or other
  misc_feature (514)..(514): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaaacttcttagcctggtaccaacagagaccaggacagcctcctaagttgctcatttactgggcttctatgcgcgaattcggggtccctgaccgattccggggcagcgggtctgggacagatttcactctcaccatcagcagcctgcaggctgaagatgtggctagtttatactgtcagctaattntttttctacttcctcgtgtacgttcgaccgaggaccgagggtcgaatcgaagacgaagtggtggctggcctaccntcg

SEQ ID NO: 44907 - DNA, 554 bp, Homo sapiens
  misc_feature: GYAE6OF02I47RH.19.67.G01.1.454.CMB.1.raw
  modified_base (362)..(362): a, c, t, g, unknown or other
  misc_feature (362)..(362): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctggggcggtctctgagactgtcctgtgaaccctctgggttctccgtcagcagcgactgtattgcctgggtccgcaggctccgagggaagaggccggagtgggtcgcgaggtattttagtaggtgggacgacnttcgtacggagactccgagtcggagggccgagttcaccgatacctcagacgtactttctcacgacacactgtctcttacaaatcgaacagcctggacgggccgagggacacgggccgtcgtacttagtgtgttagaggtaggtttagtggggtatggtcgtgggtggacgaggtatcgacggtgggacccgg

SEQ ID NO: 44908 - DNA, 545 bp, Homo sapiens
  misc_feature: GYAE6OF02HGOHF.19.67.G01.1.454.CMB.1.raw
  modified_base (416)..(416): a, c, t, g, unknown or other
  misc_feature (416)..(416): n is a, c, g, or t
  modified_base (509)..(509): a, c, t, g, unknown or other
  misc_feature (509)..(509): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctcgtcagcagcgactgtattgcctgggtccgccaggctccgagggaagaggccggagtgggtcgcaggttatttttatagggtgggacgacatttcgtaacggagactccatgggagggccgattcaccatctccagagtacttttcncacgaacacactgtctacttcaaatgaacagcctggacgggccgaggacacgggcctctattatgtgtagagtagtttagtggcgtagtcggntgggtggacaggatcgacgtggggacctaaccgggg

SEQ ID NO: 44909 - DNA, 548 bp, Homo sapiens
  misc_feature: GYAE6OF02JEKO5.19.67.G01.1.454.CMB.1.raw
  modified_base (238)..(238): a, c, t, g, unknown or other
  misc_feature (238)..(238): n is a, c, g, or t
  modified_base (444)..(444): a, c, t, g, unknown or other
  misc_feature (444)..(444): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaacttctagcctaggtaccaacagagaccaggacagccctcctaagttgctcatttactggcttctacgcgcgtaattcggggtccctgaccgagttccggggcaggcgggtctgggacagatttcactctcaccatcagcagcctgcaggctagaagatggtgctagtttactactgtcagctaatttntttttctattccctcgttggtaccgttcggaccgtaacgggacctagggtaggaaaactcgaaggaacgtaacgttggtacggtctcgaccaccctattcttcg

SEQ ID NO: 44910 - DNA, 781 bp, Homo sapiens
  misc_feature: GYAE6OF02IBKEG.19.67.G01.1.454.CMB.1.raw
  modified_base (189)..(189): a, c, t, g, unknown or other
  misc_feature (189)..(189): n is a, c, g, or t
  modified_base (284)..(284): a, c, t, g, unknown or other
  misc_feature (284)..(284): n is a, c, g, or t
tcagtactctcgtgcacgaccggtgctcgatttagagtatacatattgggtttgggggagaggagcccagcactgggattccgaggtgtttccattcggtgctcagcactgaacacagaggactcacatggagttttggctgaccttggttttcctgctgcaatttcaggtagtgtccagtgtgaggtncaacgtggtggagacgtggcggagcttggtccagccgttgggcgttctacgtgagtcttggtcctaggtcgaacccgttgtcggggtctcccgtnacgcacgcgtactgtattgccgtggtccgccaggcctccgaagggacgaggccgggaagtgggcgcgttagggttactttttaggacggtggacgactagttacgtacggataccgtcaaggtcgggaacggtccgaagtttccgaaccgtacgttaccttaccgaacgtaacggttaaccgtttttacgtaccgaaacggtaaaaccttaccgtaacgttacggttttacccgtacctttaacggtaaaacttacggaaaacccgttacggtaccccgttagggtaaacggggaccccggttaaagggaaccccgaaccggggttcccgttaacgtttaacgttttaaacggttcggttacggtttacgtaaagggtttacgttttacggtttacgggaccggttaacgtttggggttaccggttagggtttaccgggacgtaaacggtacggttaccggtaccggtttaccggggggacccttaaacccgggggg

SEQ ID NO: 44911 - DNA, 523 bp, Homo sapiens
  misc_feature: GYAE6OF02F0INS.19.67.G01.1.454.CMB.1.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaacaaaaacttcttagcctggtaccaacagagaccaggacagccctcctaagttgctcatttactgggcttctacgcgcgaattcggggtccctgaccgagttccggggcagcgggtctgggacagatttcactctcacatcagcagcctgcaggctagaagntgtgctagtttatacgtgtcagctaattnttttcttatccttcgtgtacgttcggacctaagggacctagggtagaaatcgaagaccgaactggtcggctgcaccatctcg

SEQ ID NO: 44912 - DNA, 545 bp, Homo sapiens
  misc_feature: GYAE6OF02G0559.19.67.G01.1.454.CMB.1.raw
  modified_base (414)..(414): a, c, t, g, unknown or other
  misc_feature (414)..(414): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctggggtctccgtcagcagcgactgtattgcctgggtccgccaggctccagggaagaggccggagtgggtcgcaggttattttataggtgggacgacattcgtacggagactccagtgggagggccgattcaccatcctccagacgtacttttcncagaacacactgtctcttcaaattcgaacagcctggacgggccgaggaccacggccgtctattattgtgtgagtagtttatgggcagttcgggcttgggtggacaggtatcacggtggggacctaacgggg

SEQ ID NO: 44913 - DNA, 764 bp, Homo sapiens
  misc_feature: GYAE6OF02IECD6.19.67.G01.1.454.CMB.1.raw
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
tcagtactctcgtgcacgaccggtgctcgatttagagtatacatattgggtttgggggagctacaacaggcaggcaggggcagcaagatggtgttgcagacccaggtcttcattttctctgttgctctggatctctggttcctgcggggacatcgtgatgacccagtacccagactcactggctgtgtctctgggcgagcggccacaatcaactgcaggtccagccagactatttcnccacctacaagaacaaaaacttcttancctaggtaccaacagagaccaggacagcctacctaagttgactcatttactgggtcttctatgcgtacgaacgttccgggtcctcgaccgtagttccggggcaacggtcgggttactcggggaaccagtaagttttccaccgttccgtaccaccctagtcctaacggaccacggtaccccgttagaccgtaacgggaccttagggaaacgtaagtttcgggtagggtaacccttaaggtttttaaacgtttaccgttacggtttcgaaaccggttaaccttaaacgttttacgtttttttttaccgtttaaccctttccccgtttacccgggttacgggttaacccggtttacccggggaacccggtaaacccgggggtaacccgggttaaacgggggtaacggttaaaaccggttaaccggtaaaccggtaacccggtaaaccggtttcggtaacggggtaccctttacgggacccctaaccccgagttttaaccccgg

SEQ ID NO: 44914 - DNA, 538 bp, Homo sapiens
  misc_feature: GYAE6OF02GBCPU.19.67.G01.1.454.CMB.1.raw
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctggggtctccgtcagcagcgactgtattgcctgggtccgccaggctccgagggaagagggccggagtgggtcgcaggtatttttanaggtgggacgacattctacggagactccatggagggccgattcaccatctccagagtacttttcncagaacacactgtctcttacaaatgaacagcctgacgggccgaggacacggcgtctattatgtgtgagtagtttagtggacgtatcgggtcttgggtaggacgtaggacgtccgacggtcggggg

SEQ ID NO: 44915 - DNA, 522 bp, Homo sapiens
  misc_feature: GYAE6OF02G2E0S.19.67.G01.1.454.CMB.1.raw
  modified_base (232)..(232): a, c, t, g, unknown or other
  misc_feature (232)..(232): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctcaagaacaaaacttcttagcctggtaccaacagagaccaggacagcctcctaagtgctcatttactggcttctacgcgcgaattcggggtccctgaccgattccgggcaggcgggtctgggacagatttcactctcaccatcagcacgcctgcaggctgaagatgtggctagtttatactgtcagctaattatttttctattccgtcggttggaccgtttcggaccgtaagggacctaggggtagaactcgaagacgaactgtcggctgccacatcgtgtcttc

SEQ ID NO: 44916 - DNA, 624 bp, Homo sapiens
  misc_feature: GYAE6OF02JCHGI.19.67.G01.1.454.CMB.1.raw
  modified_base (548)..(548): a, c, t, g, unknown or other
  misc_feature (548)..(548): n is a, c, g, or t
tcagtactctcgtgcacgaccggtgctcgatttagagtatacatattgggggttgggtaggaggaggcccacgcactgggagttccgtacggtggtttcctacttcggttggctcagcactgaacacagaggactcaccatggagttttggtctgacctgggttttccttgctgcaatttcaggaggtgtccagtgtgaggtgcaactggtggagactggcgggaggcttggtccagccgtgggcggtcctctgagactgtcctgtgaacccctctggggtctccgtcagcagcgactgtattgcctgggtccgccaggctccagggagaggccggaggtgggtcgcgagggttattttagtaggtgggacacatttctaacggagactccagtgggacgggccgattccaccatcctaccgaagtagtacctttttcacagaaccacacttgtccttcttacaaatcgaaaccacgcctaggaacggggccgaagaccgacgggtcccttattagtttacttggtgttagaagttacggtttttagnggggccgtaagttggggtaccttggggttaggaccgaaggtactcggtaccggtcggggggacccgtaaaccgggg

SEQ ID NO: 44917 - DNA, 554 bp, Homo sapiens
  misc_feature: GYAE6OF02HTUOL.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccgggagtgggtcgcgagggtatttttagtaggtggggacgacattctacggagactccatggagggccgattccacatctccagagacttttctacagaacacactgtactcttacaaatgaacagcctgagggccgaaggacacggccgtctattattcgtgtgagtagtttagtgggtcgtatgggtcgtgggtggacgaggagtcgaacggttggggacccgtaaccgggg

SEQ ID NO: 44918 - DNA, 531 bp, Homo sapiens
  misc_feature: GYAE6OF02FWSI1.19.67.G01.1.454.CMB.1.raw
  modified_base (410)..(410): a, c, t, g, unknown or other
  misc_feature (410)..(410): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccgggagtgggtcgcaggttatttttagtaggtgggacgacattcgtacggagactcatggagggccgattcacatctccagagacttttcncagaacacactgtcttcttcaaatgaacagcctgacgggccgaggaccacggccgtctattagttgtgtgagtagtttagnggcgagtggcgtggtcggacaggactcgacgtgggacccg

SEQ ID NO: 44919 - DNA, 533 bp, Homo sapiens
  misc_feature: GYAE6OF02F7PRO.19.67.G01.1.454.CMB.1.raw
  modified_base (489)..(489): a, c, t, g, unknown or other
  misc_feature (489)..(489): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtccctgtgaaccctctggggtctccgtcagcagcgactgtattgcctgggtccgccaggctccagggaagaggccggagtgggtcgcaggtatttttagtaggtggggacgacgattctacggagactccatggagggccgattcaccatctccagacgtacttttctcagaacacactgtcttcttcaaatgaacagcctgaggccgaggacacggccgtctattattgtgtgagtagtttanggtcgatggcgtggtggacaggatcgacgtggggcctaaccggg

SEQ ID NO: 44920 - DNA, 556 bp, Homo sapiens
  misc_feature: GYAE6OF02I1CT6.19.67.G01.1.454.CMB.1.raw
  modified_base (424)..(424): a, c, t, g, unknown or other
  misc_feature (424)..(424): n is a, c, g, or t
  modified_base (456)..(456): a, c, t, g, unknown or other
  misc_feature (456)..(456): n is a, c, g, or t
  modified_base (508)..(508): a, c, t, g, unknown or other
  misc_feature (508)..(508): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaacccctcgtggggtcctccgtcagcagcgactgtattgcctgggtccgccaggctcagggagagggccggaggtgggtcgcgtaggttattttagtagggtgggacgacagtttcgtacggagactcagtgggagggccgattcaccatctccagagtacttttcncagaacactactgtctcttacaaatcgaaacncgcctaggacgggccgaggacacggccgtcttattatgtgtgagtagtttangggcgtagtgggtctgggtggacgagatcgacggtggggccaacgggg

SEQ ID NO: 44921 - DNA, 533 bp, Homo sapiens
  misc_feature: GYAE6OF02F9MER.19.67.G01.1.454.CMB.1.raw
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttanagggtgggacgacattctacggagactccatgggagggccgattcaccgatctccagagacttttcncagaacacactgtctcttacaaatgaacagcctaggacgggccgaggaccacgggccgtctattattggtgtagagtgtttanggngatggctggtggacagatcgacgtggggcctaacggg

SEQ ID NO: 44922 - DNA, 548 bp, Homo sapiens
  misc_feature: GYAE6OF02GP41M.19.67.G01.1.454.CMB.1.raw
  modified_base (412)..(412): a, c, t, g, unknown or other
  misc_feature (412)..(412): n is a, c, g, or t
  modified_base (489)..(489): a, c, t, g, unknown or other
  misc_feature (489)..(489): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcgaggttatttttagtaggtgggacgacattctacggagactccatggaggccgattcaccatctccagagacttttcncagaacacactgtctcttcaaatgaacagcctgagggccgaggacacggccgtctattattgtgtgagtagtttagngggtcgtagttgggcttgggtacggacaggtactcgacggttgggggaccctaacgggg

SEQ ID NO: 44923 - DNA, 524 bp, Homo sapiens
  misc_feature: GYAE6OF02FMIN7.19.67.G01.1.454.CMB.1.raw
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
  modified_base (490)..(490): a, c, t, g, unknown or other
  misc_feature (490)..(490): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcagggtatttttagaggtgggacgacatttcacggagactccatggagggccgattcaccatctccagagtacttttcncagaacacactgtctcttcaaatgaacngcctgagggccgaggacacggccgtctattattgtgtgagtagtttagnggcgattggctgggtggacagactcacgtcgggg

SEQ ID NO: 44924 - DNA, 611 bp, Homo sapiens
  misc_feature: GYAE6OF02G84KZ.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggcttggtccagccgtgggcggtctcgtgagactgtcctgtcgaaccctcgtggggtctccgtcagcagcgactgtattgccgtgggtccgccgaggcgtccgagggaagacgggccggaggtgggtcgcgtaggttattttagtagggtgggacgactagttcgtacggagactcgagtggacgggcgattcacctatcctaccgagtacgtacttttcacgaacgtaacactaacttcgtccttacgttactaaatcgaaaccgagccgtaggacgggccgaacgggaccgaccggccgtacgttattagttgtgtgaagttacgtttagtcggtcgtagtcgggtcgttgggtaggaacgaggtatccggacggtcggggacccgtaaccgggg

SEQ ID NO: 44925 - DNA, 562 bp, Homo sapiens
  misc_feature: GYAE6OF02ILDN9.19.67.G01.1.454.CMB.1.raw
  modified_base (238)..(238): a, c, t, g, unknown or other
  misc_feature (238)..(238): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctccaagaaacaaaaacttcttagcctaggtaccaacagagaccaggacagcctacctaagttgctctatttactgggtcttctacgcgacgtaattcgtcgtccctgaccgacgttccggggcaggcgggtcgtgggacagtatttcactctacaccatcagcacgcctgcaggctagaagtatggtgctagtttacttactgtcagtactaatttactttttcttactccgtcgtacggtacgttcggaccgaagggtaccgtaagggtggtaaatcgaacggaacgtaacttgggtcggcctacgccacctattccg

SEQ ID NO: 44926 - DNA, 663 bp, Homo sapiens
  misc_feature: GYAE6OF02ILL57.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtctgtgaaccctctggggtctccgtcagcagcgactgtattgcctgggtccgcaggctccgaggggaagaggccggagtgggcgcgtaggttattttagtagggtgggacgacgtatttcgtaacgggatactccgaagttcggggaacggggtcccgtaagtttccaacccgtattcctacccgagtaacggtaactttttccacgtaacgtaaacctaccgaacttcggtccttaactttaccgaaaattacgaaacctacggtacccgtagggaaccggggacccggaacgggaacccgaccgggtcccgttacgttaattttaacgttgttacggttgaacggttagtttaagtgggtacgtagtggtcgttggtaggactaggtactcgtacggtcgggtaccgtaaccgggg

SEQ ID NO: 44927 - DNA, 541 bp, Homo sapiens
  misc_feature: GYAE6OF02GXPVF.19.67.G01.1.454.CMB.1.raw
  modified_base (413)..(413): a, c, t, g, unknown or other
  misc_feature (413)..(413): n is a, c, g, or t
  modified_base (442)..(442): a, c, t, g, unknown or other
  misc_feature (442)..(442): n is a, c, g, or t
  modified_base (493)..(493): a, c, t, g, unknown or other
  misc_feature (493)..(493): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgagggagaggccggagtgggtcgcgaggttatttttagtaggtgggacgacagttctacggagactccagtggaggccgattcaccatcctcagagtacttttcncagaacacactgtctcttacaaatgaacngcctgacgggccgaggacacgggcctactattattgtgtgagtagtttagnggacgtagtggcttgggtcggacaggtactcgacggtggggtacccgg

SEQ ID NO: 44928 - DNA, 715 bp, Homo sapiens
  misc_feature: GYAE6OF02HF190.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccgccaggctccgagggaagagggccggaggtgggtcgcgtaggttagtttttagtagggtggggacgacgtatttcgtacggagtacgtccgagtcgggagggcccgtaattccgaaccgtattccgtaccgaaggtaacgttaaccttttttcgtaccgaacgtaaaccactaaccttcggttcccttacctttaaccgaaaagttcgaaaacctacggtacccgttagggaacggggtacccggaaacgggtacccgaccggggtacccgttaccgtttaagtttacgtttacggtggttagtaagggttacggttttaagtcggggtaacgtaaggttcgggtccgtttaggggtacgggtactaagggtacgttacccggacgggttacgggggtacccgtaaaccggggg

SEQ ID NO: 44929 - DNA, 550 bp, Homo sapiens
  misc_feature: GYAE6OF02HIA5K.19.67.G01.1.454.CMB.1.raw
  modified_base (417)..(417): a, c, t, g, unknown or other
  misc_feature (417)..(417): n is a, c, g, or t
  modified_base (502)..(502): a, c, t, g, unknown or other
  misc_feature (502)..(502): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctggggtctccgtcagcagcgactgtattgcctgggtccgccaggctccagggagaggccggagtgggtcgcgaggttatttttagtagggtgggacgacattcgtacggagactccagtgggagggccgattcacctatcctccagagtacttttcncacgaacacactgtctcttacaaatgaacagcctgacgggccgaggacgacggccgtctagtttacgtgtgtagagtagtttagnggtcgagtggctgggtagacgtagatcgacggtgggaccctaacgggg

SEQ ID NO: 44930 - DNA, 575 bp, Homo sapiens
  misc_feature: GYAE6OF02IO6B4.19.67.G01.1.454.CMB.1.raw
  modified_base (457)..(457): a, c, t, g, unknown or other
  misc_feature (457)..(457): n is a, c, g, or t
tcagtactctcgtgcacgaccggtgctcgatttagagtatacatattgggtttgggggggaggaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtcagcctgggcgtctcgtgagactgtcctgtcgaacccgtctgggtctccgtcagcagcgactgtattgcctgggtccgccaggctccagggaagaggccggagtgggtcgcgaggttattttagagggttcgggacgactagttcgtacggagtactccgagtgggaggccgtatcgaccagtctcagagtacttttctcacgaacactctacgtctacttacaatcgtaaacncgactggaacggtccgaacggactacggaccgttctaatttactggtagtcgaagtgtttaagtggccgtagtggtacgtggtacggacacggatcggacgttcgggacggtaaccgg

SEQ ID NO: 44931 - DNA, 545 bp, Homo sapiens
  misc_feature: GYAE6OF02ICD89.19.67.G01.1.454.CMB.1.raw
  modified_base (446)..(446): a, c, t, g, unknown or other
  misc_feature (446)..(446): n is a, c, g, or t
  modified_base (498)..(498): a, c, t, g, unknown or other
  misc_feature (498)..(498): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtcccgccaggctccgagggaagaggccggagtgggtcgcgagggtatttttataggtggggacgacagtttctacggagactcagtgggaggccgattcaccatctccagacgtacttttctcagaacacactgtctcttcaaatgaacngcctgagggccgaggacacgggccgtctattattgtgtgagtagtttatggngatgggcttggaggtacaggtagtacgacgtgggggcctaaccgggg

SEQ ID NO: 44932 - DNA, 527 bp, Homo sapiens
  misc_feature: GYAE6OF02GMNZA.19.67.G01.1.454.CMB.1.raw
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
  modified_base (491)..(491): a, c, t, g, unknown or other
  misc_feature (491)..(491): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccgaggggaagaggccggagtgggtcgcaggtatttttanaggtgggacgacattcgtacggagactccatggagggccgattcaccatctccagagacttttcncagacacactgtctcttcaatgaacagcctggacgggccgaggacacggccgtactattagtgtgtgagtagtttanggtcgagtggctgggtggacaggatcgacgtcgggg

SEQ ID NO: 44933 - DNA, 656 bp, Homo sapiens
  misc_feature: GYAE6OF02G409W.19.67.G01.1.454.CMB.1.raw
  modified_base (252)..(252): a, c, t, g, unknown or other
  misc_feature (252)..(252): n is a, c, g, or t
tcagtactctcgtgcacgaccggtgctcgatttagagtatacatagttgggttgggggagctacaacaggcaggcaggggcagcaagagtcggtgttgcagacccagggtcttcatttctctgttgctctcggattctctaggttcctggcggggacatcgtgatcgacccagtacccagacctcactggctgtgtctcgtgggcgagacggccaacaatcaactgcgaggtccagccagaactattttccnccgacctcaaagaaacctaaaaacttcttagaccttacggtaaccaacacgacgaccaggacacgaccctaccgtaaggttcgacctctaacgttttaacgtgggtcctttacgtaccggccgtaccgtaacgttccgggggtcccctaggaacccggtagttcccgggggcacgggtcgggtctaggggacaggtactttcacctctaccacctactcacgtcacgcctggcaggctagaagtgtaggtcggtactttaggtttacttagttagactaaaactaatttaactttatttaattaccgtttcgtaggtaccggttaccggaaccgtaagggtaccgtaagggtgtaactacgtacgaaggaccgtaagtcggttcggctacgccactcttcgtcg

SEQ ID NO: 44934 - DNA, 497 bp, Homo sapiens
  misc_feature: GYAE6OF02G3HAJ.19.67.G01.1.454.CMB.1.raw
  modified_base (232)..(232): a, c, t, g, unknown or other
  misc_feature (232)..(232): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccacctcaagaacaaaaacttctagcctggtaccaacagagaccaggacagcctcctaagttgctcatttactgggcttcacgcgcgaattcggggtccctgaccgattccggggcagcgggtctgggacagatttcactctcaccatcagcagcctgcaggctgaagatgtggctagtttattactgtcagctaattattttctatcctcgtgacgttcgcaaggccagggtgaatcgagacgatgtgctgcaccatctgtctc

SEQ ID NO: 44935 - DNA, 562 bp, Homo sapiens
  misc_feature: GYAE6OF02F3W8W.19.67.G01.1.454.CMB.1.raw
  modified_base (346)..(346): a, c, t, g, unknown or other
  misc_feature (346)..(346): n is a, c, g, or t
  modified_base (411)..(411): a, c, t, g, unknown or other
  misc_feature (411)..(411): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccaggctccagggaagaggccggagtgggtcgcaggtatttttanaggtggggacgacattctacggagactccatggagggccgattcaccatctccagagacttttcncagaacacactgtctcttacaaattgaacagcctagacgggccgagggaccacgggccgttctagttacttggtgtgagtagtttatgggtcgaagttgggccttgggttaggaccaggtaactcgaccgttgggggaccctaaccggggg

SEQ ID NO: 44936 - DNA, 534 bp, Homo sapiens
  misc_feature: GYAE6OF02GO462.19.67.G01.1.454.CMB.1.raw
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
tcagtactctcgtgcacgaccggtgctcgatttagagtatacatattggttttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccactcaagaacaaaacttctagcctggtaccaacagagaccaggacagcctctaagttgctcatttacngggcttcacgcgcgaattcggggtccctgaccgagttccgggcaggcgggtctgggacagtactttcacttctcaccatcagcagcctgcaggctaggaaagtntgtggctagttttattactgtcagtctaattnttttcttatcccttcggtagtaccgtttcggaccaaagggccgtagggtgaaatcgaagaccgtaacgtgtaggctagcaccgtatctgtccttac

SEQ ID NO: 44937 - DNA, 577 bp, Homo sapiens
  misc_feature: GYAE6OF02FUUI1.19.67.G01.1.454.CMB.1.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
  modified_base (530)..(530): a, c, t, g, unknown or other
  misc_feature (530)..(530): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggccagcctggggcgtctctgagactgtcctgtcgaccctcgtggggtctccgtcagcagcgactgtatgccgtgggtccncgaggcctcgagggaagcgggccggaggtcgggtcgcgtaggttattttagtaggtgggacgatattcgtacggagtactccagtgggagggtccattccactatcctacagacgtacttttcncaagaacacacttcgtactcttacaatagaacacgccgtaggacgggtccgacggacgacccggtccgttactatttacgttgtcgtagtagtacgttttagngggtacgagttggtgttaggcggacgtagtacgtacgacggtcgggg

SEQ ID NO: 44938 - DNA, 570 bp, Homo sapiens
  misc_feature: GYAE6OF02G7HHB.19.67.G01.1.454.CMB.1.raw
  modified_base (526)..(526): a, c, t, g, unknown or other
  misc_feature (526)..(526): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctcgtgagactgtcctgtcgaaccctctggggtctccgtcagcagcgactgtattgccgtcgggtcccgccgacggctccaggggaagagggccgggagtggggtcgcgtaggttatttttagtaggtgggacgacgattctacggagacgtccagtggagggccgagttccaccatcctccagagtacttttctcagaacacactgtctcttacaatgaacagcctggacggccgacggacgacggccgtactatttattgtgtgtagtacgtttagtcggtcgagttggngttgggtggacgtagacgtcgaccggtggggaccgtaaccgggg

SEQ ID NO: 44939 - DNA, 663 bp, Homo sapiens
  misc_feature: GYAE6OF02IN7MA.19.67.G01.1.454.CMB.1.raw
  modified_base (182)..(182): a, c, t, g, unknown or other
  misc_feature (182)..(182): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
tcagtactctcgtgcacgaccggtgctcgatttagagtatacatattgggtttgggggggaggaggagcccagcactgggattccgaggtgtttccattcggtgctcagcactgaacacagaggactcaccatggagttttggctgaccttgggttttccttgctgcaatttcaggtaggtntccagtgtgaggtgcaactggtgagactggcggaggcttggtccagccgtgggcggtctcgtgagacttggtcctgtcgaaccctcgtgggtctccgtcagcagcgactgtattcgccgttcgggtccgacgacggcctaccgaagggacgacgggccggaggtcgggtcgcgtaggttattttaggagggtgggacgtaactagttacgtacggacgtacgtccagtcgggacggccgtattccgactactctaccgagtactccttttnacgataaaccacacgttgtcttacctttacaaatcgaaaccncgtccgtacgggaacgggtacccggaacgggaccgtaccgggtaccgttacttaagtttacgtttgtggttacgtaaggttagtttagtcgggtacgacggttggggccgtttagggcggtaacggtaggtactccgggaacgttcgggggaacccgtaacccggggg

SEQ ID NO: 44940 - DNA, 541 bp, Homo sapiens
  misc_feature: GYAE6OF02GXW8C.19.67.G01.1.454.CMB.1.raw
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccagcctgggcggtctctgagactgtcctgtgaaccctctggggtcctccgtcagcagcgactgtattgcctggtccgccnggctccgagggaagagggcggagtgggtcgcgaggtattttagtaggtgggacganagttctacggacgactccagtggagggccgtattcaccatctccagagtactttcncagaacacactgtctcttacaatgaacngtcctaggagggccgagggacacggccgtntattatgtgtgagtagtttgnggcgtagtggacgttgggtggactaggtatccgagtccgggg

SEQ ID NO: 44941 - DNA, 714 bp, Homo sapiens
  misc_feature: GYAE6OF02GKMSK.19.67.G01.1.454.CMB.1.raw
  modified_base (238)..(238): a, c, t, g, unknown or other
  misc_feature (238)..(238): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactatttcnccacctacaaagaacaaaacttctagcctacggtaccaacagagaccaggacagcctcctaagttgctctaattctgggcttctacgccgtacgtaacgtttccggggtcccctaggacccgtacggttcccgggggacacgggtccggggttcgtcgggggaacctaggtacttttccaacgttctccaacctagtaccagccagcctgcgaggctaaggaagtagttggtcgggactttaagttttacgttacgtcgttaccaggttaacctaatttttacgttttttaccttaacgtttccccgtttaccggttagggttacccggtttccgggtaacccggtaaacggggtccccgggttaaagggggttacggtaaaaacggtttcccggaaacgggttaaacccgtaaacggttcggggttaccggtacgttaaccggacccttaaccgttacgttcccggtttaaccgg

SEQ ID NO: 44942 - DNA, 562 bp, Homo sapiens
  misc_feature: GYAE6OF02IMEVJ.19.67.G01.1.454.CMB.1.raw
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (511)..(511): a, c, t, g, unknown or other
  misc_feature (511)..(511): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtcgaaccctctggggtctccgtcagcagcgactgtattgcctgggtccgccaggctccgagggaagaggccggagtgggtcgcgaggttattttagtaggtgggacgacattcgtaacgganacgtccaagtgggagggccgattccaccatctccgagagtacttttcncagaacacactgtctcttacaatgaacagcctaggacgggccgaaggcgaccggcgtactagttaattggtgtgtagtagtttatggngagtgggtctggggtagacgagtagtccgtacgtcggggacctaaccgggg

SEQ ID NO: 44943 - DNA, 533 bp, Homo sapiens
  misc_feature: GYAE6OF02FLYIR.19.67.G01.1.454.CMB.1.raw
  modified_base (415)..(415): a, c, t, g, unknown or other
  misc_feature (415)..(415): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtatgcctgggtccgccaggctccgagggaagaggccggagtgggtcgcgaggtatttttagtaggtgggacgacattctacggagactccatgggagggccgattcaccatctccagagtacttttcncagaacacacttgtctcttacaaatgaacagcctgacgggccgaggacgacggccgtactattagttgtgtgagtagtttntggcgtagtggcgtggtggaacgngatcgagtcgggg

SEQ ID NO: 44944 - DNA, 721 bp, Homo sapiens
  misc_feature: GYAE6OF02IY3A6.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggccagcctgggcggtctcgtgagactgtcctgtgaaccctcgtgggtctccgtcagcgagcgactgtattcgcctcgggtccgccgaggtcctccgagggaagacggccggagtgggtcgcgaggttatttttagagggttcggacgtactagttctacgggacgactccgagtggggacgggtcccgtaagttccgaaccagtacccgtaccaacggtaacgtaccgtttttcctacgtaacgaaacctactaaccgttcggtaccttacctttaacaaaacgtacgtaaaaccgacgtacccgtacggtaacgggacccgaacgggaaccgtacccgggacccgttaaccgtttaagtttacgtttacggtaggtttacgggtaagttacgggtttttaagtccggggtacggttaaagttcggggtaacggttcgggttacgggaacgtacggtaccgtaacggtaccggttaccggggggaccgtaaaccccggggg

SEQ ID NO: 44945 - DNA, 586 bp, Homo sapiens
  misc_feature: GYAE6OF02I7BI5.19.67.G01.1.454.CMB.1.raw
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (524)..(524): a, c, t, g, unknown or other
  misc_feature (524)..(524): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactggcggaggcttggtccagcctgggcggtctcgtgagactgtcctgtgaaccctctggggtctccgtcagcagcgactgtatgcctgggtccgccaggctccgaggggaagacgggccgggaggtgggtcgcgtagggttatttttagtagggtgggacgtacgtatttcgtacgggagactccgagtgggacgggtccgagttccaccgtatcctaccgaggacgtacttttcacagaacacactgtctctanaatgaacngcctggacggcgaggacacggcctactatttagttgtagtgtagtagttttagnggtcgtagtgggccgttgggtacgacgaggtacgtaccggacggtggggacccgtaaccggg

SEQ ID NO: 44946 - DNA, 559 bp, Homo sapiens
  misc_feature: GYAE6OF02G8L7V.19.67.G01.1.454.CMB.1.raw
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggttgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccnccaggctccgagggagaggccggagtggggtcgcaggttatttttagtaggtgggacgacattctacggganactccagtggagggccgattcacatctccagagtacttttcncagaacacactgtctctnaaatgaacagcctagagggccgaggaccacgggacctctatttattggtgtgtagtagtttagtggcggtattgggcgttggtacggaagaggacttcgacggtcgggggacccaagggtaaccccg

SEQ ID NO: 44947 - DNA, 681 bp, Homo sapiens
  misc_feature: GYAE6OF02GMHU8.19.67.G01.1.454.CMB.1.raw
  modified_base (239)..(239): a, c, t, g, unknown or other
  misc_feature (239)..(239): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctggggcgtctcngagactgtcctgtcgaaccctcgtggggtctccgtcagcagcgactgtattgcctgggtccgccaggctccgaggggaagagggccggaggtgggtcgcgtagggttatttttagtagggtgggacgacgtagtttaccgtacggacgactccagttggggacgggcccgtaagttccaaccgtacgtcctaccgaggagttacctttttctacgaagaaccactacgtgtaccttctttaacaaatacgaacaacgtccgtagggaacgggccggaagggaaccgaccggggtcccgttacgtacgtttaagttgttaggtacggtaggttaggttttacgtacgggtcgtaacggtttggggtaccggttaggggtacgggtaacctacgggtaaccgttaccggaaccgggttcggggggaccccgtaaacccgggggg

SEQ ID NO: 44948 - DNA, 540 bp, Homo sapiens
  misc_feature: GYAE6OF02I5O9D.19.67.G01.1.454.CMB.1.raw
  modified_base (239)..(239): a, c, t, g, unknown or other
  misc_feature (239)..(239): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttcnccacctccaagaacaaaaacttcttagcctggtaccaacagagaccaggacagccctcctaagttgctcatttacgtggcttcacgcgcgaagttccggggtcctggaccgtagttccggggcaggcgggtctgggacagtatttcactctcaccatcagcagcctgcaggctgaagatggtgctagtttatactgtcaagtctaatttctttttctattcccgtcgtggtacgttcggacgaagggaccgtagggtggaaatcgaagacgtacgtggtcggctacgacaccgtatcgtcg

SEQ ID NO: 44949 - DNA, 659 bp, Homo sapiens
  misc_feature: GYAE6OF02IXXO0.19.67.G01.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttccnccacctccaagaacaaaacttctagcctaggtaccaacagacgaccaggacacgccctacctaagttcgctcatttacngggtcttctacgcgcgtaagttccgggtccctgaccgagttcccggggnaggtccgggtctgggacaggtatttccactcctacacctactacgacgcacgtccctaggccgaggtccgtaggaagtacgttggtacgggtacttaagtttttagttacggttcgttacgtacgtaacgttaacctttaattttttacctttttacttacccgttccccggttaggttaccgggttaccggttacccggaaccggtaacgggtaccggtaggggttaacgtaactcggaacgtaacggtaacgttggtaccgtacgtacgtcctaacgtcttacgttacgttaccc

SEQ ID NO: 44950 - DNA, 565 bp, Homo sapiens
  misc_feature: GYAE6OF02GVS2F.19.67.G01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (461)..(461): a, c, t, g, unknown or other
  misc_feature (461)..(461): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacggccacaatcaactgcaggtccagccagaactattttccnccacctccaaagaacaaaaacttcttaagcctggtaccaacagacgaccaggacagcctacctaagttgctcatttacngggtcttctacgcgtcgtaagttcggggtccctggaccgagttcccggggcacggtcgggtctgggacagtatttcactctcaccatcgagcagcctgacnggcagaacgngtgtgactagtttatactgtcagtctaaattnttttttctacttccgttacgtgggtaccttcggaccgtaagggtccgtagggtaacgtaactcgaagtacgtaacgttgtacggcttggacctacgtctcttcg

SEQ ID NO: 44951 - DNA, 737 bp, Homo sapiens
  misc_feature: GYAE6OF02HPY0C.19.67.G01.1.454.CMB.1.raw
  modified_base (490)..(490): a, c, t, g, unknown or other
  misc_feature (490)..(490): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgaccttgggttttccttgctgcaatttcaggaggtgtccagtgtgaggtgcaacgtggtggacgactggcggaggcttggtccagccgtgggcggtctcgtgacgactcggtcctgtgaacccgtcgtgggtctccgtcagcagcgactgtacgttcgccgtcggtcccgccgacggcgtaccgaagggaaggacggaccgggaggttcgggtcgtccgtagggttaatttttaaggtagggttaggggaacgtacgaacgtttcgtaacggacgtactaccgagtcgggaacgggtccgtaacgtttccgaacctactccgtaccaaggtacgtttaacttttacncgtaagtaaaccactaacttcggttaccttacttaacgtaaaacgttacgaaacctagtccgtaacggacggggtaccgaacgggtaaccgaaccggtacccgttacgttaagtttacgttaggtacggttagtaacgtttaggttttaggtacgggtacggtacggtttagggcgtttaacggggttacggaacggtacggtaacggttaccgtaccgggttacggggacccgggtaaacccgggg

SEQ ID NO: 44952 - DNA, 606 bp, Homo sapiens
  misc_feature: GYAE6OF02FQL39.19.67.G01.1.454.CMB.1.raw
  modified_base (549)..(549): a, c, t, g, unknown or other
  misc_feature (549)..(549): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaccctctggggtctccgtcagcagcgactgtattgcctgggtccgccaggcctccgagggaagagggccgggagtgggtcgcgtaggtatttttagaggtggggacgtactatttcgtaacggagactccaagtgggagggcccgtaagtttccgaccctatcctaccaagacgtactttttcacaacggtaaccaccacttcggttcttacctttacaaagtcgaacagccctaggacggggccgaaggaccgaccgggtccgtctagttattgtgtagacgtagttttagngggtacgtagttgggcgttaggggtcggtacgaggtacttaccggacgtaccggggg

SEQ ID NO: 44953 - DNA, 538 bp, Homo sapiens
  misc_feature: GYAE6OF02FW2KF.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactgggtggagactgggcggaggcttgggtccagcctgggcggtctctgagactgtcctgtgaaccctctggggtctccgtcagcagcgactgtattgcctgggtccgccaggctccagggaagagggccggaggtgggtcgcgaggtattttataggtgggacgacattctacggagactccagtggagggccgattcaccatctccagagtacttttctcacgaacacactgtctcttacaatgaacagcctgagggccgaggacacggccgtctattattgtgtgagtgtttagtggacgtagtggcgtgggtgggacgtaggagtacgacgtcgggg

SEQ ID NO: 44954 - DNA, 810 bp, Homo sapiens
  misc_feature: GYAE6OF02J1B9A.19.67.G01.1.454.CMB.1.raw
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctggtccgccaggctccagggaagaggccggagtgggtcgcaggttatttttataggtgggacgacattctacggagactccatggagggccgattccaccatctccagacgtacttttcncagaacacactgtctcttcaaatgaaacngcctgacggccgaggacacgggccgtactagttacttggtcgtgtaagtaggtttttagcgggtcggtaagttcgggtacgttggggttacggaactaaggacgttacgaaccggtcgggggtaacccgaacgggggtaaaccccgttcggggtaccctaacccggttcctaccccgttacgaccgtccccttaccccgaaaccgggtaaaccggggcccctaaggtttccccggtacccgtttaccccccggtcgggaccccggtccccgttccggacccgtttccccggaagggacccgtacccgtaaccccgttcccgggaaacggtacccgacccgaaccggaccgggccccgggtccccgttacggggacccttcggaccccggtttaccggggtaaccgtaaaccgggacccctttacccgttaccccggaacggtacgtacccgggttaaccggtaccggggtaccgggtccgggttaccgtaccggggacccgaacggggtcccaccgttaacggaacgtcgtgacg

SEQ ID NO: 44955 - DNA, 578 bp, Homo sapiens
  misc_feature: GYAE6OF02IRQKD.19.67.G01.1.454.CMB.1.raw
  modified_base (245)..(245): a, c, t, g, unknown or other
  misc_feature (245)..(245): n is a, c, g, or t
  modified_base (577)..(578): a, c, t, g, unknown or other
  misc_feature (577)..(578): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagtacttttcncagaacacactgtctcttcaaatgaacagcctggagggccgaggacacggccgtctattattgtgtgagtagtttatggcagtggctgggtggacagatcgacgtggggccagggaaccctgggtcaccggtctcccgtcacgtccctcccaaccgacgggcccacgtcggtccctttcccccgtcggcccgccctcgcctccgacggacgccaccgtccgacgacgccgacacggccggcccgtcggccgtcgccgtcggtacgaacggtacctaccgttcccgacgacgacgtacgtggacggcggcgtcggcgacggcgacagtagcgnn

SEQ ID NO: 44956 - DNA, 608 bp, Homo sapiens
  misc_feature: GYAE6OF02GJYP1.19.67.G01.1.454.CMB.1.raw
  modified_base (448)..(448): a, c, t, g, unknown or other
  misc_feature (448)..(448): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagacgtggcgggaggcttggtccagccgtggggccggtctctgagactgtcctgtcgaaccctcgtggggtctccgtcagcagcgactgtattgccgtgggtccgccaggcctccgagggaaggacgggccggaggtgggtcgcgtaggttattttagaggtgggacgagtagttacgtacggagtactaccagtgggagggccgtactttccactactctaccagtacgtacttttcctanaacgaaccactacgttgttacctcttaacaaattcgaactacgccgtggacgggccgaagggaccgtacggtccgttacgttatttagttgtagtgtaagttagtttaagtggtacgtagttcggcgttgggtcggaacgagtacgtcgaggtaccgggg

SEQ ID NO: 44957 - DNA, 685 bp, Homo sapiens
  misc_feature: GYAE6OF02J2M57.19.67.G01.1.454.CMB.1.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagtactctcgtgcacgaccggtgctcgatttagagtatacatattggtttgggcgtgggagaggagcccgagcactgggattccgaggtgtttccattcggtgctcagcactgaacacagaggactcaccatggagttttggctgacctggttttcctgctagccaatttcaggaggtgtccagtgtgaggtgcaacgtggtggaagcgtggcggagcgttaggccagccgtgggcggtctacgngngactgtccngtcgaaccgtcgtggtctccggtcagcgtagcgtacctgtatcgtcgtcgggtccgacgtacgcgtccgagggtaacgcggacccgggtggtacggtcggacgtacggttagttttttagaggtggggtacctacgtactttcggtacggagtacttccgtaagtacggggtcgggaccgtagtaccgacgtacgtaccgtacgacgtacgtaccttttacgaccgtagtaaccctaacgtccgtaggtttccctacgttacgtaaattaccggtaactacggtcctagggtaccgggaccgtacggtaccgaacccggttccggtacgttacgtttaacgttcgtacgtttagacggtttacgtttaaggtccggagtacggttagccgttaggttccggagtacgtacgtacgtacgggtaccgg

SEQ ID NO: 44958 - DNA, 672 bp, Homo sapiens
  misc_feature: GYAE6OF02HEZHP.19.67.G01.1.454.CMB.1.raw
  modified_base (318)..(318): a, c, t, g, unknown or other
  misc_feature (318)..(318): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtatgcctgggtccgccaggctccgagggaagnggccggagtgggtcgcgtaggttattttagtagggtggggacgactagtttcgtaacggagtacgtccgagttggggacgggtcccgatttccaccctagttcctaccaaggtactaccgtttttctacgaacggaacctacacgttcgtaccttcctttacaaacgttcgaaacctcgaccttagggacggggacccggaggaaccgaaccgggtcccgttacttaacgttttagttggttaggttagtaaggttacggtttagtcgggtcggtaacgttggggtaccgttaggggttacggaaccgtaggtaacgttacccggtacgggtacgggggacccgtaaccggggg

SEQ ID NO: 44959 - DNA, 682 bp, Homo sapiens
  misc_feature: GYAE6OF02H7065.19.67.G01.1.454.CMB.1.raw
tcagtactctcgtgcacgaccggtgctcgatttagagtatacatattgggggtttggggagaggagcccagcactgggattccgaggtgtttccattcggtgctcagcactgaacacagaggactcaccatggagttttggctgacctgggttttccttgctgcaatttcaggaggtgtccagtgtggaggtgcaactgggtggagactggcgggaggtcttggtccaggcctggggcggtctctggagactgtcctgtcgaaccctcgtggggtctccgtcagcagcgactgtattgccgtggtcccgccgaggctccgagggaggaggccgggtaggtgggtcgcgtaggttattttagagggtagggacgtacgactttcgacggacgtactcgagtggggacgggtccgtaacgttccaacccgtactcccgtaccgaaggtaccgttactttttccgacgtaacgtaaaccactacttacggttaccttacttaacaaacgtcaaacctacgaccgtaggtacggggacccgaagggaccgaccgggtccgttacgttattttacggttcggttaggtttaggacggtttaaggttttacgtacggggtacggtacgttagggtccgtagggttaacgacgtaggtacctacggacgggtcggggacgtaacccggg

SEQ ID NO: 44960 - DNA, 637 bp, Homo sapiens
  misc_feature: GYAE6OF02I17R3.19.67.G01.1.454.CMB.1.raw
  modified_base (239)..(239): a, c, t, g, unknown or other
  misc_feature (239)..(239): n is a, c, g, or t
  modified_base (335)..(335): a, c, t, g, unknown or other
  misc_feature (335)..(335): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactggctgtgtctctgggcgagacggccaacaatcaactgcaggtccagccagaactatttccnccacctaccaaagaaacaaaaacttctagacctaggtaaccaacagacgaaccgaggacacgtccctaccgtaagttcgacttactattttaccgngggtccttacctacggcgtacgtaacggtttccggggtaccctggacccgtacgttccggggacacggtcgggtacgtgggactacgtatttccacgtcctaccaccatccacgcgacgccctggaccgagggtctaggaacgtgtgggtcgtacgttaagttttacttaacctgtaacaaactaattatttattattacgttcgtacggtacgttcggaaccgtaaacgggtaccgtaagggtcgtaagtcgtaccgaagtaacgtaacgtggtacggtctacggacctacgtatcgttcg

SEQ ID NO: 44961 - DNA, 704 bp, Homo sapiens
  misc_feature: GYAE6OF02HKEJM.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtctctgagactgtcctgtgaaccctctcgggtctccgtcagcagcgactgtattgccgtgggtccgccgaggctccagggagacggccggagtgggtcgcgaggtatttttagagggttgggacgacgtagttcgtacggagactccgaagtcgggaggggcccgaatttccaacctactctcccgtaacgacggtaaccttttttctcgaacgaacctaaccgacttcgttactccgtttaccaaagttcgaaaccacgtacccgtaggtacggggacccgaacgggaccgtacggggacccgttacgttaacgttttacgtttcgggttagtttacggtaaggttacggttttttaaggtcggggtaccggtaagttcgggggttccgttggggtttaaccgggaccgtaacgggtaacgttaccccggtaacgggtttccggggggaccccggttaaacccgggggg

SEQ ID NO: 44962 - DNA, 754 bp, Homo sapiens
  misc_feature: GYAE6OF02JW3DG.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttcctgctgcattcaggaggtgtccagtgtgaggtgcaactggtggagactggcggaggcttggtccagcctgggcggtctcgtgagcctgtcctgtcgacctcgtgggtcctccgtcagcacgcgactgtacttgccgtgggtacccgccgacggcctccgaggggtaacgacgggacccggaggtcggggtccgcggtaaggttatttttacggaggggttcgggaccgacgtagttaccgtaacgggagtaccgtccgaagtggggacgggtcccgagttaccgaccgtacgtccgtacccgtaaggtacgttaccctttttacgaccgtaacgtaaacctacgtaccgttacggttccttaacgtttacctaaaacgtacgtaaaccgtacggtacccgttagggaccggggtacccggaacggtaacccgtaccgggtacccgtttacgttaacgttttaaacggttcggttaacgttacggtaggttaacggttttaacggtacggggtaccggtaaggttcgggttaccgggttagggtacgggtaacgtagggttaaccgtaccggttaccggggtaccggggtaaccccggg

SEQ ID NO: 44963 - DNA, 589 bp, Homo sapiens
  misc_feature: GYAE6OF02HOW4R.19.67.G01.1.454.CMB.1.raw
  modified_base (442)..(442): a, c, t, g, unknown or other
  misc_feature (442)..(442): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctggggtctccgtcagcagcgactgtattgccgtggtcccgccaggctccgaggggaagaggccggagtgggtcgcgtaggttatttttagtagggtgggaacgactagtttcgtaacgggagactccgagtgggaaggggcccgaattccgacctatcctaccgagtacgtacttttcncaagaacacactcgtcttcttacaaatagaacagccgtaggacgggccgaaggacgacggccgtcttattacgtgtgtgtagtagtttagtgggcgtagtggtcgtggtaggacgacggtatccgaacgtcggggacctaaccgggg

SEQ ID NO: 44964 - DNA, 656 bp, Homo sapiens
  misc_feature: GYAE6OF02ITQQL.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcgttggtccagccgtgggcggtctcgtgagactgtcctgtcgaacctcgtcgggtctccgtcagcagcgactgtattcgccgtgggtccgcgacggctccgagggacgacgggccggaggtgggtcgcgtaggttactttttagaggtgggacgacgtagttacgtacggacgactcgagtcgggaggtccgtattccgacgtactcctaccgagtacggtaccttttcacgaacgtaaaccacgtacgttcgttacctttacttacaaacgtacgtaaccacgtacccgttaggaacgggtacccggaacgggaacccgaccgggttacccgttacttaacgtttacgttaggtgttaggagttacggtttaagtcgggtacggtagttcggtacgttgggtacggacgtaggtacgtaccggacggtaccggggg

SEQ ID NO: 44965 - DNA, 575 bp, Homo sapiens
  misc_feature: GYAE6OF02HE3MK.19.67.G01.1.454.CMB.1.raw
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgccgtgggtcccgccaggctccgaggggaacgaggccgggagtcggggtcgcgagggttatttttagagggtgggacgactatttcgtacggagactccgatgggagggccgattcaccatctccagagtacttttcncanaacacactcgtcttcttacaatcgaacagcctggacgggccgaggaccgaccggccgtacgtattacgttgtgtagagtaggtttagtcgggcgtagtgggcgttgggtggacgtaggagtccgacggttcggggacctaacgggg

SEQ ID NO: 44966 - DNA, 549 bp, Homo sapiens
  misc_feature: GYAE6OF02HFMK6.19.67.G01.1.454.CMB.1.raw
  modified_base (318)..(318): a, c, t, g, unknown or other
  misc_feature (318)..(318): n is a, c, g, or t
tcagtactctcgtgcacgaccggtgctcgatttagagtatacatattgggtttggggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagctgtcctgtcgaaccctctggggtctccgtcagcagcgactgtattgcctgggtccgcaggctccgagggaagnggccggagtgggtcgcgaggtatttttagaggtggacgactattctaggagactccatgggagggccgattccaccatcctaccagacgtacttttctacagaacacacgtgtcttcttacaaatgaacagcctggacggccgaggaccacggccgtctagttattgtagtgagtgtttagtggacgtagtggacgtgggtcggacagtagtaccgacgtcggggtacccg

SEQ ID NO: 44967 - DNA, 729 bp, Homo sapiens
  misc_feature: GYAE6OF02I5F5B.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactgggcggaggcttggtccagccgtggggcgtctcgtgagactgtcctgtcgaccctcgtggggtctccgtcagcagcgactgtattgccgtcgggtcccgccaggcgtccgaggggaagagggccggaggtcgggtcgcgtaggtttattttagtagggtgggacctaatagtttacgtaacggagaccttaccgaaggttcgggacgggaccctacttaccgaaccctacttcctaccgaaggtaacgtttactttttccgacgtaaacgaacctacgtaactcgttaacttacctttaacaaacgttacgaaaccgtacggtacccgtagggaacgggtacccgggaacgggaacccgtaccgggtacccgtttacgttaacgttttaagtttacggttggtacgtaacggtttaggttttaacggttcgggtaacggtggttaccgggttggttacggggtaggtaacggtaacggttacgtaccggtacgggtaccggggacccggtaaacccgggg

SEQ ID NO: 44968 - DNA, 763 bp, Homo sapiens
  misc_feature: GYAE6OF02JUPD4.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcgttggtccagcctgggcgtctcgtgagtactgtcctgtcgtaaccctcgtcggggtctccgtcgacgtcgacgcgtacgtgtagttcggccgttcgggtaccgccgaggccgtaccgagggtaacggaggtccggaggttcggggcgacgtaagggtttagtttttcggtaagggttcgggaacgtacgtagtttacgtaccggaagtccgttaccgaagttacggggacggggacccgttagttacccaaccggtacttaccgtacgtaacggtaacgttaccttttaccacgtaaacgaacctacgtaaccgttcgttaccttaccgttaacgtaaaacgtacgtaaacctacggtaccgtagggtaacggggaacccgtaacgggtaacccgaaccggggtcccttaacggtttacgtttacggtttacggtagttacggtaagggtacgttttaggtacgggtacgttaaggttcgggttacggtacgggtaggtaccggtaacgtaccgtccggtaagggtccgggaaccgggtaacccggg

SEQ ID NO: 44969 - DNA, 799 bp, Homo sapiens
  misc_feature: GYAE6OF02F6KS5.19.67.G01.1.454.CMB.1.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctcgtggttcctggcgggactatcgtgatcgacccagtacccagactcactggctgtgtctcgtggcgacggacgccacaactcaactgctaggtccagccagtactntttccnccacctacaaanaaactaaacttctancctagtaccaacagacacaggacacgtacctacgtaagttcgcttactaatttacgtggtccttacgacgcgtacgtaacggttccgggtaccctcggaccgtacggttcccgggggactacgggccggggttactacggggaacctaaggttacttttacccgaccgttccgttaacccaaccgttacgttacccgaaaggtcccgtaaccggtaccgttacggtaccgaaaccgggttccgtaagggtaaaaccgggttagttccggggttaccggttaacgttttaaacgttttaaccgttaaccggtcgtaccggtaaacttaccgttaaagttttttactttttttacccgttacccgtttcccggttaccggggttacggttaccccggtttaaccggtaaccgggaaacgggttacccggttaaggggttaaccggtaaaacggtaccgaaacggggttaaccgtaaccggtttggaccgggttaacctaggacccctacgtttacgcgttttacccgg

SEQ ID NO: 44970 - DNA, 632 bp, Homo sapiens
  misc_feature: GYAE6OF02GTBH5.19.67.G01.1.454.CMB.1.raw
  modified_base (349)..(349): a, c, t, g, unknown or other
  misc_feature (349)..(349): n is a, c, g, or t
  modified_base (564)..(564): a, c, t, g, unknown or other
  misc_feature (564)..(564): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtggcggaggcttggtccagcctgggcgtctctgagctgtcctgtcgaacctgtcgggtctccgtcagcagcgactgtatgcgtgggtccgccgaggtctccgagggtacgacggcggagtggtcgagtaggttactttagngggtggacgtacgtattcgacggagactcgagtggacggctagttcaacctatcctaccgaagtacgtacttttcacgtaacgaactaccgtacgttgtactttacgtaactaaagtacgaaccgtagtaccgtacgggacgggtacccgaagggtccgaaccgggtccgttaactttacgttacggttgttacgtagtaacgttagggtttacngggtacgtaagtcgggtctaggggtacgaacgtggtacgtacgtcgggtaccgggacgtaacccgggg

SEQ ID NO: 44971 - DNA, 592 bp, Homo sapiens
  misc_feature: GYAE6OF02HJ9JQ.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttggtccagcctgggcgtctctgagactcgtctgtcgacctcgtgggtctccgtcagcagcgactgtagttgccgtcgggtccgccgaggtcctccgaagggtaagacggccggaggtgggtcgcgtaggttacgttttagtagggtgggacgacgtattcgtacggagtactaccgtagtcggacggtccgagttccgactactctacacgtacgtacttttacactacgaacactactgtctcttacaactagaactacgctggacgggccgaggacgacgtccgtactagttagtgtgtagagtagttagtcggtacgtagtggtcgttggtacggtagacgtagtcggtaacggtgggaccgtaccgggg

SEQ ID NO: 44972 - DNA, 633 bp, Homo sapiens
  misc_feature: GYAE6OF02ITNPQ.19.67.G01.1.454.CMB.1.raw
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
tcagtactctcgtgcacgaccggtgctcgatttagagtatacatattgggtttgggtacgaacaggcaggcaggggcagcaagatggtgttgcagacccaggtcttcatttctctgttgctctggatctctggttcctgcgggacatcgtgatgacccagtacccagactcactggctgtgtctcgtagggcgagaccggccaacaatccgaactgcgaggtccagccagtaactcttttccnccaactccgaaagaaacctaaaaccttcttaacgacctacgtaaccaacagacgaccagacacgcctacctaagttcgctactatttacgnggtaccttcgtacgcgtacgtacgttccgggtcctaggaccgtgtacccgggnacggtcggtcgcggacgagtacttcgactctaccaccgtatcgacacgactcccgtgctacggcttaacggagtactcggtaggactttaagttttcgtaactcgactacgtctaaagttttcttttacctctccgttcgtacggtacttacccggacgtaaacgggcgtaggaggtaacctcgaaggtaccgtacgtaaggtccggtagtacctacgaccgtactttcggtactttccctaacgg

SEQ ID NO: 44973 - DNA, 554 bp, Homo sapiens
  misc_feature: GYAE6OF02G6YGP.19.67.G01.1.454.CMB.1.raw
  modified_base (242)..(242): a, c, t, g, unknown or other
  misc_feature (242)..(242): n is a, c, g, or t
  modified_base (379)..(379): a, c, t, g, unknown or other
  misc_feature (379)..(379): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (507)..(507): a, c, t, g, unknown or other
  misc_feature (507)..(507): n is a, c, g, or t
  modified_base (551)..(553): a, c, t, g, unknown or other
  misc_feature (551)..(553): n is a, c, g, or t
tcagtactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggaggccgattcaccatctccagagacttttcncagaacacactgtctcttcaaatgaacagcctgagggccgaggacacggccgtctattatgtgtgagtagtttatggcgtatggctggtggacagatcgacgtggggccaggggtaaccctggtcgtaccgtctccncacgccctccaccgaacggcccatccggtccttccccctcggccgtccctcgcctccaggaccncgaccnccgagacgcacgacggccgcccgtgggcctcgccgtgtacgacggtactccgtccagngacgtacgtcggacgcgggctacggacgacggcgactagtacgnnng

SEQ ID NO: 44974 - DNA, 665 bp, Homo sapiens
  misc_feature: GYAE6OF02JTTTN.19.67.G01.1.454.CMB.1.raw
  modified_base (176)..(176): a, c, t, g, unknown or other
  misc_feature (176)..(176): n is a, c, g, or t
  modified_base (307)..(307): a, c, t, g, unknown or other
  misc_feature (307)..(307): n is a, c, g, or t
  modified_base (641)..(641): a, c, t, g, unknown or other
  misc_feature (641)..(641): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggtttctgctgcaatttcaggagtntccagtgtgaggtgcaactggtggagacgtggcggaggcttgggtccaggcctggggccggtctccggagactggtcctgtcgaaccctcgtggggtctccgtcagcagcgactgtatcgcctgggtcccncgaggcctccgagggaacgcgggccggaggtcgggtacgcgtaggttagtttttagtacgggtcgggtacgacgtagttcgtaacgggacgtacgtaccgagttcgggacggggaccgtaactttccgaaccgtagtccgtacccaagggtacgttaacctttttcgaccgtaaagaacctacgttacgttcggtaccttacgttaacgaaacgtacgaactacgaccggttggaaccgggtaccgaacgggaccgtccggtaccttagtacttacgtggtagttacgagtttacgttagcggtacgtaggtcggtaggtacggtacgacgtanacggtacgtagggcggtaacccgg

SEQ ID NO: 44975 - DNA, 671 bp, Homo sapiens
  misc_feature: GYAE6OF02F66XH.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggttttccttgctgcaatttcaggaggtgtccagtgtgaggtgcaacgtggtggagactggcggaggcttggtccagccgtgggcggtctctgagactgtcctgtgaccctcgtgggtcctccgtcacgcagcgatcgtattgccgtgggtccgccgaggcctccgagggaaggacgggccggaggtgggtcgcgtaggttgttttagtaggtgggacgtactattacgtacggacgtactaccgtagtgggacgggccgtacttcgaaccgtacttaccgtacccaaggtaccgttaaccttttttccgacctaaacggtaaacctaccgtacgtttacgttccttacgtttaaccaaaagttcgaacctacgtccgtaggacgggtccgaaggaccgacggtccgttacgttaatttagttggttacgtaggtaacgttacgggttttaagcggtacggtaaggttcggcggttaggggttacggaacgttaaggacgttaccggaaccgggtcgggg

SEQ ID NO: 44976 - DNA, 673 bp, Homo sapiens
  misc_feature: GYAE6OF02G3LJ3.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggagcttggtccagcctgggcgtctctgagactgtctgtgaccctcgtgggtctccgtcagcagcgactgtattcgccgtgggtcccgccgaggctccgaagggaagacggccgggaggtcgggtcgcgtaggtttagttttagtagggtggacgtactagttcgtacggagactcgagtcgggaaggccgtacgttccacctactccgtccgaagtacgtactttttcacgtaacgaacactacgttcgttaccttacgttaacaaagtacgaaaccgtacgtacccggtagggaccgggacccggtaacgggaccgtaccgggtacccgttacgttaacgtttagtcggttagtaggttacgttaggtttacgtcgggtacggtacggttacgggtcgtttacggggtagtaacggtacgtacgtaccggtacgggtacgggggtacccgtaacccgggg

SEQ ID NO: 44977 - DNA, 776 bp, Homo sapiens
  misc_feature: GYAE6OF02JG97J.19.67.G01.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttcctgctgcaatttcaggagtgtccagtgtgaggtgcaactggtggagacgnggcggaggcttcggtccacgccgtgggcggtctctgagactgtccttgngtaccctgtggggtcctccgtcagtccgagcgacttgtacttcggcccgtcgggtccggcgacggtctccggaggggaaggcggccgggtaggttgggtcgacgtaagggttactttttaaggcggngggggaactacctagttacggtacggaaggacccttacgtaagtcggggaccgggccgttacctttanacccgtaaccgtcgtcccgtaacggtaacgtaccttttacccgtacgaacgtaaccaacctaccgttcggttccttacctttaccgaaataccgtaacgaccggtaccttaacgggaccggggtaaccgggtaaccgggaaaccgtaccccggtaccggtttaccgtttaaagtttaacggtttagttacggtacgggtttaacgggtaacggtttttaacggtccgggttaaaccgggacggtttacgggggtacccggttaggggttaccgggtaaccgtaacggtaaccggtttaccggtaccggggttaacccgggggg

SEQ ID NO: 44978 - DNA, 566 bp, Homo sapiens
  misc_feature: GYAE6OF02G29IA.19.67.G01.1.454.CMB.1.raw
  modified_base (417)..(417): a, c, t, g, unknown or other
  misc_feature (417)..(417): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttgggtccagcctggggcggtctctgagactgtcctgtgaaccctctggggtctccgtcagcagcgactgtattgcctgggtccgccaggctccagggaagaggccggagtgggtcgcaggtattttagtaggtgggacgacatttctacggagactccagtggagggccgattcaccgatctccagacgtacttttcncagaacacactgtctcttcaaatgaacagcctggacgggccgaggacgaccggcgtctattagttcgtagtgtagtacgtttagtcgggctagtggcgttgggtaggacgtaggacgttacgaccggttagggggcccgtaaccggggg

SEQ ID NO: 44979 - DNA, 722 bp, Homo sapiens
  misc_feature: GYAE6OF02IA7Y5.19.67.G01.1.454.CMB.1.raw
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcgggacatcgtgatgacccagtacccagactcactggctgtgtctcgtgggctaggacggccacaatcaaactgcaggtccagccaagaactattttccnccactccaagaacaaaacttctagcctgtacaacagagaccagacagcctactaagttnctctatttacgnggcttctacgcgacgtaagttccggggtcctggacccgtagttcccggggctacgggccgggtcncggggtactaggtatttcccgacttccgtaccaccgtaactccgaagtccgacgtaccctcggacgtacgggtaccgtaggaaacggtcgttacggttcgggtaacgttacgtttttaaacgttacgttccggttacgtacggtaaccttaaactttttacgttttttaccgttaacgttaccccgtttaccggttaacgggttacccggttttacccgggaccttaaaaccgggggacccgttaaggggtaacgttaacgttccgaaacgggttaacccgtaacggttaggttccggtaccgttacggacccctaccggaactttcgttacggtttccctttaaccgg

SEQ ID NO: 44980 - DNA, 565 bp, Homo sapiens
  misc_feature: GYAE6OF02G8YIJ.19.67.G01.1.454.CMB.1.raw
  modified_base (468)..(468): a, c, t, g, unknown or other
  misc_feature (468)..(468): n is a, c, g, or t
  modified_base (523)..(523): a, c, t, g, unknown or other
  misc_feature (523)..(523): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagactggcggaggcttggccagcctgggcgtctctgagactgtcctgtcgaaccctctggggtctccgtcagcagcgactgtattgcctgggtccgccaggctccgagggaagcggccggagtgggtcgcaggttattttagagggtgggacgtactagttcgtacggagacctccgagtgggacgggccgtattccaccatcctaccgagtacgtacttttcctacgtaacgaaccactactcgtactcttacaaatcgaacngcctggacggccgagacgaccgccgttactattagtgtgtgtagttattagtggntagtggctgggtgactaggctacgagtcgggaccgtaacggg

SEQ ID NO: 44981 - DNA, 772 bp, Homo sapiens
  misc_feature: GYAE6OF02JM2RM.19.67.G01.1.454.CMB.1.raw
tcagtactctcgtgcacgaccggtgctcgatttagagtatacatattgggtttggggcgtgggaggaggagcccagcactgggattccgaggtgtttccattcggtgctcagcactgaacacagaggactcaccatggagtttggctgacctgggttttccttgctgctaatttcaggaggtgtccagtgtgaggtgcaactgggtggagacgtggcgggagcgttggtccagccgtggggccggtctcgtgagtactgtcctgtcgacccgttctgggtcctccgtcagccagcgactgtacttcgccgtgggtccgccgacggctccggagggaaggacgggccgggacggtgggtcggcggtacggttatttttacggaggttaggggacgtacgtacgtttcgtaacgggacgtaccgttccgaagtttcggggaacggggtcccgtacgtttaccgaacccctaagtccccgtaccgtacggtaacgttaccctttttaccgcgtaacggtaaaccaacgttaccgtaggttccctttaccgttaccgttaaaactacgtaaacccacggtacccgttacgggtaacggggtcccggaaacgggtacccggaacccgggggttaccgttacccggttaatttaaccggttaggtttacggttggtaacggttacggttttaacgggtggttaaccgggtacggttacggtcgggttcggggttaacggaccgtaacgggtaagttcccgggtaacgtacccgggggg

SEQ ID NO: 44982 - DNA, 871 bp, Homo sapiens
  misc_feature: GYAE6OF02GMDLD.19.67.G01.1.454.CMB.1.raw
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccaagaactattttcctcccacctaccaaagaaaacctaaaaaacctttcttaacgccgttacggtaacccaaacacggaacgaacccgaaggaaccacgtacccttaccgttaaagtttcgaccttactaacgtttttaaccgtcggggtaccttttaccgtaaccggccggtacggtaaaccgttttcccggggggtaccccttacgggaaccccggtaacggtttccccgggggacgtacggggtccggggtttaccgtagggggaacctaaggttacttttccaactttccctaccgaaccctagtaccaacggtacccaacggtccccgttggacccggtacgggtaccgtaagggaaaacgtagttcgggtacggttacttaaaggtttttaactttaacgtcggttaaccgtaagtaacccgtttaaatttttacctttttttaccgtttaaccgttaccccggtttaccgggtttacggttaacccgggttttcccggaacccgggttaaacggggttaccccgtagggggttaacggtaaacctaccgggtaaaggaaccccggttaacggtttcgggtaccggtaccgttaccggaaccgttaacccgttacggttacccgttttacggttaccctttaaccg

SEQ ID NO: 44983 - DNA, 784 bp, Homo sapiens
  misc_feature: GYAE6OF02JLZ33.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatgggagttttggctgaccttgggttttccttgctgcaatttcaggagtgtccagtgtgaggtgcaagtgggtggagacgtgggcggaggtcgttcggtcaggccgtggggccggttctcgtggagtactggtcctggtcgaccctcgtggggtcctccgtcagcgagcgtacgtgttatcgccgtgggtcccgcgtacggcctaccggaaggggtaacgacgggccgggaggtcgggcggtacgtagggttttaagtttttaagtacggggtaggggaccgtacgtaacgttttcggtaacggggaacgtaccgtaccgtaggttacggggaacggggtcccgtatttacccgaccttaattcccgtaccgaagtacgtttacttttaccgtaacgtaaccgtaacctactaccgttcgttaccttaccgttacctaaagttaccgaaaccttaccggtaccgtacggggaacggggtaacccggacgggtaacccgtacccggggttacccgttacgtttacgttttaaagtttcggttacggttaaggttacgggttagtttaacggttcgggtacgtaaggttggggtacgttagggtacggtacggtaaggtaccgtacggtacgggttacggggacccgtaaccgggg

SEQ ID NO: 44984 - DNA, 798 bp, Homo sapiens
  misc_feature: GYAE6OF02ISIJG.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctggcgggacatcgtgatcgaccagtaccagactcactggctgtgtctacgtgggcaggaccggaccacagtaccaacttgaccaggtccaggcctaagaacttacgtttcctccccactaccaaagaaacctaaaacttccttacgccgttacgaacccaaacgaacgtacgaaccgacggaaccgtacgtaccccttaccgttaaaggtttcgaccttaccgttaacgttttaacccgtcggggttacccttttacctaaccgggtacccggtaaccggttaaccgtttacccggggggtacccccttaaggaaccccggttaccggttcccgggggactaacgggtccggggttaacgtcggggtaaactacgggtattttacccgaccttaccgtaccaaccttagaacctaccggtacgtacgtcccgtggacgtaacgggtcctaaggtaaacgacggttcgggtaacggtactttaacgggttttaactaccgttggtaacctaagttaacctttaagttttcgttttttacctaccgttccgtcgggtttaaccttacgggtccgaccgttaagggaccgtaggggttacgaaacggtctaaggaaccctaggttggtacggacctcgaaccgtcctacgttcttaccgg

SEQ ID NO: 44985 - DNA, 620 bp, Homo sapiens
  misc_feature: GYAE6OF02JC2VV.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcgtctctgagacgtgtcctgtcgaaccctcgtggggtcctccgtcagcagcgactgtattcgccgtcggggtcccgccgacggccgtccgaggggaaggacgggccgggaggtgggtcgcgtaggttattttagtagggtggacgacagtttcgtacggagtactcgagtgggaggccgtattccaccatccgtacgagtacgttccttttacacgacgaactactactcgtccttcgttaacaagttcgaactcgtaccgagggaccgggaccgaagggccctaccgggtaccgttacgttaatttagttgtagtagtaggttagtttagcggtggtagtgggtcgtagggtgacgagtaccgtcgaccggtggggacctaaccggg

SEQ ID NO: 44986 - DNA, 612 bp, Homo sapiens
  misc_feature: GYAE6OF02JDRVV.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttcctgctgcaatttcaggaggtgtccagtgtgaggtgcaactggtggagacgtggcggaggcttgggtccagccgtgggcggtctcgtgagactgtcctgtgaaccctctggggtctccgtcagcagcgactgtattgcctgggtccgccgaggctccgagggagaggccggagtcgggtcgcgtaggttatttttagaggtgggacgacattctaggacgtactccgagtggacgggccatttcacctatcctccgagtacgtaccttttcacgacgaaccacactcgttactccttacaaatcgaacgacgtcctggaccgggacccgaggaccgaccggccgttacttacgtttaagttcgttacgtgtaacggttagttttaaggtcgggtacgtaagttcgggtaccgttagggttacggacgtaggacttaccgacggttacccggggg

SEQ ID NO: 44987 - DNA, 718 bp, Homo sapiens
  misc_feature: GYAE6OF02HN6QP.19.67.G01.1.454.CMB.1.raw
  modified_base (281)..(281): a, c, t, g, unknown or other
  misc_feature (281)..(281): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagacgtggcggaggcttcggccaggcctgggccgtctctggagactgtcctgtcgaacccgtcgtgggtcctccgtcngcagcgtactgtatgccgtcgggtcccgcgcggctccgaagggacgacgggccggaggtcgggtcgcgtaggttacgttttagtagggtgggacgactacgttcgtaacggacgtacgtccaggtgggacgggccgtaagtcccaaccgtacttacgtaccgacgtacgttacctttttaccgtacctaaacgaaacctacctaaccgttcgttaccttaccgttaactaaacttacgaaaccgaccgtaccgtacgggtaacgggacccggaaacgggaccggaaccgggttcccggttaactttacgtttaacgttcggttgttacggtaacggtttaggtttaacggtgggtaccggttaggttcgggtcggttcgggtaggaacgtacggtaacgtaccggtacgggtaccggggtccccgtaaacccggggg

SEQ ID NO: 44988 - DNA, 608 bp, Homo sapiens
  misc_feature: GYAE6OF02JQ3GA.19.67.G01.1.454.CMB.1.raw
  modified_base (282)..(282): a, c, t, g, unknown or other
  misc_feature (282)..(282): n is a, c, g, or t
  modified_base (554)..(554): a, c, t, g, unknown or other
  misc_feature (554)..(554): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttgggtccagccgtgggcggtctcgtgagacgtgtcctgtcgaccctgtgggtctccgtcagcngcgactgtattgccgtgggtccgccgaggcctaccggagggagacgggccggaggtcgggcgcgtaggttattttagaggtggaacgatagttcgtaacgggagtacgtcgagtggacgggtcctagttaccaccgtagtcctacgacgtactaccgtttcacaacgtaacacctacttcgtacttcttacaaactcgaactacgacgtacggacggaccgacgaccgacggtaccgtacgttacgttagtgtgtagtacgttagttacggnggtacgtaggtggtacgtggtacggacgagtagacggtacggacgggtacccgg

SEQ ID NO: 44989 - DNA, 861 bp, Homo sapiens
  misc_feature: GYAE6OF02FGDEF.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttggtttcctgctgcattcaggagtgtccagtgtgaggtgacaacgtgggtggacgacgtgggcggaggtccttgggtcccaggtcccgtggggtaccgttctccgtggtagtaccttcggtaccctggttaccgaacccgttcgtcggggtcctccgtcgacgctacggccgtacgttgtacgttcggtccccgtcgggttccccgaccgtacggtccgttaccggaagggaacggacggggtccggtaggttcggggtacgtaccgtttaagggttttaacttttttaaggacgggggttacggtaacccgtaacgttacgtttaccggaacgggtaacgaccgttaccgaggtacggggaccggggtacccgtaattcccgaacctacgttcccgtaaccgtacggtactttacccttttacgaccgtaacgtaaacctaaccgttaaccgttccgtaacctttacgttaaccgaaacgttaccggtaaacgaccgaccgggttacgggaacccggggacccggaacggtaacccggtaacccgggtttccgtaaacgtttttaacggtcgttttaaacgggtggttaccggttaaggtttacgtttacgacgggtttacggaggtttacggtccggttagggtaacccggtacgtaaggacccggtttacgaacccgggggttccgggtaaccccgtaaccccggggg

SEQ ID NO: 44990 - DNA, 838 bp, Homo sapiens
  misc_feature: GYAE6OF02HYVAP.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggtagttttggctgaccttgggtttttccttgctgctaatttcgaggaggtgtccagtgtggaggtgcaacgtggtggagacgtgggcggaggtcgttcgggtccaggccgtgggtcggtctcgtgagctgtcctgtcgtaccctcgtcggggtcctccgtcgagcgagcgactgtacttcgccggtcgggtcccgccgacgggccgtaccggaaggggaacggacggggccgggtagggttcggggtccgtacggtaacgggttttaagttttttaacggtaggggttacgggaaccgtaacgttaacgttacggtaaccgggtacgtaccgtaccgaggtacggggacgggtacccgtactttaccgacccttaacgtacccgttaccgaacgggttaaccgtttaacccgtttttaacccgttaaccgaaacgtaaacccgaaccgttaccgtttaccgttcccttacctttaaacgtaaacgttaccgtaaaccgtacgtacccggtagggaacccggggaccgggaaccggtaaccggtacccgggtacccgtttacgtttaacgtttacggtttaggttaggttacggtaaggttttacggtttacggtacgggtaccggtaggttcggggttaccggttaggggttacgggtaaccgtaacggtacgtacccgggtaccgggtaccgggggtaaccccgg

SEQ ID NO: 44991 - DNA, 653 bp, Homo sapiens
  misc_feature: GYAE6OF02J16TF.19.67.G01.1.454.CMB.1.raw
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (506)..(506): a, c, t, g, unknown or other
  misc_feature (506)..(506): n is a, c, g, or t
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttcctgctgcaatttcaggagtgtccagtgtgaggtgcaacgtggtggacgaacttgggccggaggctttgggtcccaggccttggggcgtctcgtagagtactggtcctgtgaacccctctggggtctccggttcagtcagcggactgtatgcctggtccgcagctcgaggagagggccggagtgggtcncgacggttagtttttanagggtgggacgactacgttctaacgggagaccgttccgaagtgggaacgggtccgaagtttccacccgagttctacccgagagtaccttttttcgacgttaagaacctaaccagttccgtacgtcctttacaaattcgaaaccgngtaccttgggaacggtcccggacgaccggtaacccgggtccgtcctttaaacttgttagtcggtagtacggtagtttacggtgtcgggtaatggggtactaggggtcggaaacgtgacgtactacgggtacggggcctaacccgggg

SEQ ID NO: 44992 - DNA, 578 bp, Homo sapiens
  misc_feature: GYAE6OF02I01YA.19.67.G01.1.454.CMB.1.raw
  modified_base (304)..(304): a, c, t, g, unknown or other
  misc_feature (304)..(304): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcggtctcgtgagactgtcctgtcgaacctcgtgggtctccgtcagcagcgactgtattgccgtgggtcccnccgaggctccgagggaagaggcccggaggtgggtcgcgtaggttatttttagaggtggacgacattccgacggagactccgagtcggaggccgattccacgactctcagtacgtacttttcgacagaaccacactntctcttacaatcgaacncgacctggacgggccgaggaccacggccgtattacttagttgtacgtagtagtagtttgtacgggtcgtaagtggtacgttgggtacggactaggtactacggtacggtagggtacccggg

SEQ ID NO: 44993 - DNA, 688 bp, Homo sapiens
  misc_feature: GYAE6OF02GIX48.19.67.G01.1.454.CMB.1.raw
  modified_base (212)..(212): a, c, t, g, unknown or other
  misc_feature (212)..(212): n is a, c, g, or t
  modified_base (327)..(327): a, c, t, g, unknown or other
  misc_feature (327)..(327): n is a, c, g, or t
tcagtactctcgtgcacgaccggtgctcgatttagagtatacatattgggtttggggagaggagcccgagcactgggattccgaggtgtttccattcggtgctcagcactgaacacagaggactcaccatggagtttggctgaccttggttttccttgctgctaatttcaggaggtgtccagtgtgaggtgcaacgtggtggagacgtgggnggaggtctttgggtcccaagccgtggggccggtctagtcgaagccttggtccctagtcgtaacccgtcgtggggtcctccgtcgagctagcgactgtatgccgtggtcccgccgnggcctcgaggagacggccggagcgggtcgcgtaggttattttaggaggttcgggacgtaactcgtttacgtaacgggatacgtccgagttacgggacggggtccctaagtttccgaaccgtacttcccgtaccgaagtaccggtactttttccgacgtaggtaaaccacgtaccttgtaccgtttccttaaacgtaaactacgtaaacgaacgtcccgttgggaaccgggcgtaagacccgaccggtcgttacctttacgttagtaccgtttggtagaaggttacgttttggacgggtaccgtagtggggtacctggggttcgaatggaaccttagtcccggtagggcccgtaaaccgggg

SEQ ID NO: 44994 - DNA, 595 bp, Homo sapiens
  misc_feature: GYAE6OF02G9BNL.19.67.G01.1.454.CMB.1.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtgggcggaggcttggtccagccgtgggcggtctctgagactgtcctgtcgaccctcgtcgggtctccgtcagcagcgactgtattgccgtgggtccgccgaggcctccgaggggaacgacgggccgggagtgggtcgcgtagggttatttttagtagggtgggacgactattcgtacggagactccagtggacgggcctattccacctatcctaccgagtacgtaccttttcacaacgaacactactcgtctacttacaatgaacagcctggacggccgaggaccgaccggccgtattagttagttgtcgtagtagtagtttgtggtcgtagtcggtcgttgggtacgacgtaggtacgtaccgacggtcgggaccggtaacccggg

SEQ ID NO: 44995 - DNA, 1066 bp, Homo sapiens
  misc_feature: GYAE6OF02F4486.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagacgtgggcggaggtcgttggtccaggccgtgggcggtctcgtggacgacttcgtccgtgtaccgtaaccccttcggtcgggggtccttcccggtcgacggccgaacggccgtaacgttggtttaacgtttcggtccccggttcgggggttaccccggacccgtacggggtacccgttacccgggaaacggggggtaaagggaaccggggggccccggggtaagggggttccggggggttcccggaccggttaagggggtttttaacgttttttttaaaggaacggggggttttacggggggaaccggtaaacgttaacggttttaacccgggttaaaccgggggtaaagtaaccccgttaccgtaaaggttcggggggaaccgggggttaccccgtaaacgttttaccccgaacccgttaaccgttccccgttacccggtaaagggtacgttttaacccgttttttacccgtaacctaaaacgggtaaaaccccaaacccgttaacccgtttacgggtttacccctttaaccgttttaaaccgtaaaaaactttaccggtaaaaacccgtaaggttccccggttaaaggggggaacccggggttaacccgggaaaccgggaaacccggtaacccgggggttccccgtttaccgtttaaagtttttaacgggttttacggttagggtttaacgggtaaggttttaaaccgggtttttaggtacccgggggttacggttaaaccggggtttggggtaccgggttttcggggggttaaggtaaacccggtagggttaacccggtttacccggtaacccgggggttttaccgggggggaccccggttaaaaacccccgggggggg

SEQ ID NO: 44996 - DNA, 567 bp, Homo sapiens
  misc_feature: GYAE6OF02HP5KD.19.67.G01.1.454.CMB.1.raw
  modified_base (519)..(519): a, c, t, g, unknown or other
  misc_feature (519)..(519): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtctccgtcagcagcgactgtattgcctgggtccgcacggctccgagggaagaggccggagtgggtcgcgaggtattttagagggtggacgtactagttctaggagactacgagtaggagggaccgtattcaccgtatcctcgagacgttacttttctacagaacacacttgtaccttcgttacaaatcgaaactcgccgtgacgggccgaggaccacggccgtacttagttattgtgtagtagtagtttagngggtacgtatggcgttgggtggacaggtatccgacggtgggtaaccgg

SEQ ID NO: 44997 - DNA, 776 bp, Homo sapiens
  misc_feature: GYAE6OF02HXBQH.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcacatggagttttggctgaccttgggttttccttgctgcaatttcgaggaggtgtccagtgtggaggtgcaacgtgggtggagacgtgggcggaggtcgttggtccaggccgtggggccggttctctggagactcgtcctggtacgaacccgtcggtggggtcctccgtcagcaggcgacgtgtagttcgccgttcgggtcccgaccgacggccgtaccggaaggggaacggacgggaccggaggtcgggtaccgacgtaaggttttaacgtttttaggaacgggttacggggaacgtaaccgttagtttacggtaacggacgtaacccgtccgaaggtcggggaacggtccgtacttaccgaacctacgtcccgtacgtacgtacgttaccgtttttacacgtaaagaaaccgtaacctacgttacgtacctttacgttaaacgtaaagtacgtaaaccgcggtaccggttacgggaacggggacccggaacgggtaacccggacggtacccgttactttaacgtttagtttacggtacgttaggtaggtttacggtttagtagggtaacgttaggttcgggtacgtttacggggtggtacggtaacggtaccgttacggtaccgggtacggggtaccgtaacccgggg

SEQ ID NO: 44998 - DNA, 621 bp, Homo sapiens
  misc_feature: GYAE6OF02GWR4I.19.67.G01.1.454.CMB.1.raw
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccaggcctgggcgtctcgtgagctgtcctgtcgaccctgtggggtcctccgtcagcgagcgactgtattcgcctgggtccgcaggctccgagggaagacgggccggaggtgggtcgcgagggttatttttaggtagggtgggacgacagtttcgtacggagactacgagtcgggaggtccagttcacctatcctaccagtacgtacttttcgactaagtaacaactactcgttacttaccgtttaacaaattacgaaacacgtccgtagggacgggccgaacggaccgaccgggcttacgttaattttcgttagttggttagaggttacgttttagtgggacgtagtcgggtagttgggtacgacgttaggacgtccgtacggtcggggcgtaaccgggg

SEQ ID NO: 44999 - DNA, 710 bp, Homo sapiens
  misc_feature: GYAE6OF02GHEO8.19.67.G01.1.454.CMB.1.raw
  modified_base (246)..(246): a, c, t, g, unknown or other
  misc_feature (246)..(246): n is a, c, g, or t
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctgcggggacatcgtgatcgacccagtacccagactcacgtggctgtgtctcgtgggcgagacggccaacaatcaactgcaggtccagccagaactacttttccncctacctaccaaagaaactaaaaaccttctacgcctacgtaaccaacagacgaccaggacacgtcctaccgtaagtcactctactttacgcggtcttacgtacgcgtacggtaacgttccggggtccctacggaccgtacggttccgggggctacgggtcgggttcgtacgggaactaggttacctttaccgacctttctacccgaacctagtccgaaggtaccgaggtcccgtggccgtaagggtctaacggaaggttacgttcggttagggtactttaacggttttagttaccttaggttacaaacgttcttaaagtttttctttttttaccttaaccgtttcccgtttcccgggtaacggtacccgggtttaccgggaaccgtaacgggggacctaagggggtaactaacgtcgaaacggtcgtaaccgtggtcggacctacggccctaactcgtacttcg

SEQ ID NO: 45000 - DNA, 606 bp, Homo sapiens
  misc_feature: GYAE6OF02FXBWV.19.67.G01.1.454.CMB.1.raw
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagcctgggcgtctctgagactgtcctgtcgaaccctcgtggggtctccgtcagcagcgactgtattgcctgggtccgccaggctccgagggaagagggccggagtgggtcgcgaggttatttttagagggtgggacacgtatttcgtacggagactccagtgggagggccgattccaccatctaccgagacgtactttttcgcaacgaacactactgtctacttanaaatcgaaacncgtcctggacgggaccgagggaaccgaccgggtccgttacttaacgttattggtagttggtagttagttttacgngggtacgtagttcgggcgttagggtaggactaggtactaccggacgggttcggggaccctaaccggggg

SEQ ID NO: 45001 - DNA, 763 bp, Homo sapiens
  misc_feature: GYAE6OF02IGEU0.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttccttgctgcaatttcaggagtgtccagtgtgaggtgcaactggtggagactggcggaggcttggtccagccgtggggcggtctctgagtactgtcctgtcgaaccccttgtcggggtctccgtcagcagcgactgtattgccgtggtccgccgaggcctccgagggacgagggccggagtgggtcgctaggttacttttagtaggtgggacgtacgattaccgtaacggagtacgtccgaagttcgggacgggtccgtagtttccgaacctaacgttccgttacccacggttaacgttaaccgttttttcctaccgtaacgtaaaccgtaacctaacgtttacggttaccctttacctttaaccgtaaaaacgttacgtaaaccgaacgtacccggttaacggggtaacggggaccccggtaaagggtaaccccggaaccgggttacccggtttacctttaaacggttttacgttttacgggttacgggttacggtaaacggtttaggttttaacggttacgggtccggttaaggtcggggtacccgtttggggtacgggttaaccgaacgggttaacgttccggtaacgggttaacccgggggg

SEQ ID NO: 45002 - DNA, 734 bp, Homo sapiens
  misc_feature: GYAE6OF02IH5VT.19.67.G01.1.454.CMB.1.raw
  modified_base (319)..(319): a, c, t, g, unknown or other
  misc_feature (319)..(319): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgaccttgggtttccttgctgcaatttcaggaggtgtccaggtgtgaggtgcaacgtggtggagacgtgggcggaggtcttggtccaggtccgtggggcggtctcgtggacgctgtcctggtactaccgtcgtgggtcctccgtcagcagcgtactgttatcggccgtcgggtaccnccgtacgggcctaccggtaagggaaggcggggaccgggtaggttcgggggtaccgacggttaagggtttaattttttaacggtaggggtcgggtaacgtaacgttagttccggaacgggtacgtacctaccgagtacggggacgggtaccgtacgtttccaaccgttatccgtacgagtaccgttacttttacacgaacgaaactactacgtagttccttacgttacaaacgtacaaacgtcgccgtagggaccgggtaacggacggtaaccgccgggtaccgttacgttagttacgtcgggtagttacggtagttacggtttacggtagggaccgtaaggttacgggttccggtaagggttaccgggaactaacgggtacctacgggttacccgggtacgggggtaaaccccgg

SEQ ID NO: 45003 - DNA, 691 bp, Homo sapiens
  misc_feature: GYAE6OF02FWHK0.19.67.G01.1.454.CMB.1.raw
tcagtactctcgtgcacgaccggtgctcgatttagagtatacatattgggtttggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaacctctgggtctcgtcagcagcgactgtattgccgtgggtcccgcgacggctccgagggaagagggccgggaggtgggtcgcgtaggttatttttagtagggtgggacgacgtagtttcgtaacggtaaggtacctccgaagttcggggaacggggtcccgtaactttccgaaccgtagttcccgtaccgaaggtaacgttaccttttttacctacgtaaacgtaaaccaacctaaccttcggttaccttccgttaacaaaatttggaaaccacgtaccctagggacgggacccgaagggacccgacggggtccccgttacgttagttttaagttcgttaggttacgtagttaggttttagtgggacgttagttggggccgttaggggttacgacgtaggtactaccgtacgggtaccggggccgtaaacccgggg

SEQ ID NO: 45004 - DNA, 811 bp, Homo sapiens
  misc_feature: GYAE6OF02H8Z90.19.67.G01.1.454.CMB.1.raw
tcagtactctcgtgcacgaccggtgctcgatttagagtatacatattgggggtttggggagaggagcccagcactgggattccgaggtgtttccattcggtgctcagcactgaacacagaggactcaccatggagttttggctgaccttgggttttccttgctgctaatttcgaggaggtgtccaggtgtggaggtgacaacgtgggtaggagacgtgggacggaggtcttggtccaggccgtggggcggtctacgtgacgtactcgtccgtagtacgaaccctggtcggggtcctccggtacgacgcgacgcgtacgttgtaattcggcccgttgggtacccgaccgacggtaccgtaccgaagggggaacgacggggtccgggtaggtcgggtaccggacgtaagggttttaactttttaaggtacggggtggggaaccgtaacgtaacgttttacgaacggggtactaacccttaccggaaggttcgggggaacgggtaccgtaacgtttacccaaccgtacgttaccgtaccggtaaaggttaaccgtttaccgtttttacgaacccgtaaacggtaaacctacgttaacgttaccggttaccgttaaccttaacgtaaaaagtccggaaaccgtaacgtccgtaacggacggggaccgtaagggacccggtaacgggtcccgttaattaacgtttagttcggtaaggtccggttaagttacgttttaagacgggtacgtaggttacgggtcgttagggtacggaacgtacgaacgtccggaacgggttaccgggactaacccgggg

SEQ ID NO: 45005 - DNA, 567 bp, Homo sapiens
  misc_feature: GYAE6OF02FS1FC.19.67.G01.1.454.CMB.1.raw
  modified_base (136)..(136): a, c, t, g, unknown or other
  misc_feature (136)..(136): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttccngcggggacatcgtgatgacccagtacccagactcactggctgtgtctcgtgggcgagaccggtcacaatcaactgcaggtccagccagaactnttttccnccacctcaaanaaactaaaaactcttaagcctggtaccaacagagaccaggacagccctacctaagttcgctcatttactgggccttcacgcgacgaattccggggtccctgaccgtagttcccggggntacggcgggtcgtagggactagatttacacttcncaccatcagcagcctgcaggctagaagntgtggcttagtttactacttgtacatactaatttattttacttactcccttcgtaggtacctttcggaaccgtaagggacccgtagggtacggaatacgagtaacggtacttggacgtcacgcacctgtccttgtccttc

SEQ ID NO: 45006 - DNA, 589 bp, Homo sapiens
  misc_feature: GYAE6OF02I5D9A.19.67.G01.1.454.CMB.1.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
  modified_base (539)..(539): a, c, t, g, unknown or other
  misc_feature (539)..(539): n is a, c, g, or t
  modified_base (551)..(551): a, c, t, g, unknown or other
  misc_feature (551)..(551): n is a, c, g, or t
  modified_base (570)..(570): a, c, t, g, unknown or other
  misc_feature (570)..(570): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggttttcctgctgcaatttcaggagtgtccagtgtgaggtgcaagtggtgagacgtggcggagtcttagggtccaggcctggggcggttcnctcgagacttgtcctagtcgtaacctcgtgggtctcgtcagcgngcgactagtattcgccgtaggtccgcaggtcctcgagggaacgaggtccggagtgggtcacgaggttactttaggaggtcgggacagtattcgaacgtcaacgtcagtcggacggtccgatttccaaccagtccacgaagtacgtacttttcacgaataaccacgtaatcgttctacgttcaaactnaacgctacgagtcggacctaagggacncccgggacttcgtattagttagngttacgagtacgtttntcgggatacggnggtcgtaggtcaacggtanagttaccgacggtccgggg

SEQ ID NO: 45007 - DNA, 709 bp, Homo sapiens
  misc_feature: GYAE6OF02GSBWE.19.67.G01.1.454.CMB.1.raw
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctctggggtctccgtcagcagcgactgtattgcctgggtccgccgaggctccgagggaagagggccggagtgggtcgcgaggttatttttagtagggtgggtacgacgtattcgtaacgggacgacttccgaagttcggggaacggggccgtaacgtttccaaccctacgttcctacccgaagtaacgttacttttccgtactaacgaaacctaacctaacgttcgtaccgtttacttaactaaaacgttacgaaacctacgtacccgttacgggaccggggtacccggaacggggaaccgtacccggggtacccgtttaccggtttaaagtttacggtttacggttagggttacggtaggttaacggttttaaggtcggggtaacggtaggttcgggtcggttagggtacggtacgtaagtacggtccggtacggtcggggtaacccggg

SEQ ID NO: 45008 - DNA, 789 bp, Homo sapiens
  misc_feature: GYAE6OF02GHNLE.19.67.G01.1.454.CMB.1.raw
tcagtactctcgtgcacgaccggtgctcgatttagagtatacatattggggtttgggggagctacaacaggcaggcaggggcagcaagatggtgttgcagacccaggtcttcatttctctgttgctctggatctctggttcctggcggggacatcgtgatcgacccagtacccagactcactggctgtgtctcgtgggcgagaccggccaacaatccaactgcaggtccagccagactactttccaccacctaccaaacgaaacctaaaaacttctaacgcctacggtaacccaacgagaacaccgaggaccacgtaccctaccgttaagttcgaccttactacgtttacggtcggtcctttaccgtaccggcgtacggttaaccggttcccggggtacctaccggtacccggtcggttcccggggacgtacgggtccggggttccgtaggggtaacctacggttacttccgtaccctactaacccgaacctacgtaccaacggccctaccgccgtacgacgtaccggacgtaaggaactggttacgggtcgttaacgtttaggtttttaacttccgtacgtaaccgtaacgttaattttaacgttttttaccttttttacccgtaacgttttccccggtacgggttaccgggtttacccggtaacccgggggtaaccgaaacgggggttacggtaaggggttaacgtaaaccggtaccggaacgggtaaccttaacgggttggtaccggtacgtaccggacccttaacccggttcttccgtttaccgg

SEQ ID NO: 45009 - DNA, 728 bp, Homo sapiens
  misc_feature: GYAE6OF02FLMHD.19.67.G01.1.454.CMB.1.raw
  modified_base (708)..(708): a, c, t, g, unknown or other
  misc_feature (708)..(708): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctcgtgggcgagacggccacaatcaactgcaggtccacgccagactattttcctcccacctccaaagaaccaaaaacttcttacgccttacggtaccaacaggagacccgaggacacgcctacctaagttcgctctatttaccgtgggtccttcgtaccgcgtacggtaacgtttccggggtacccctggacccggtagttcccggggcacgggtccgggttacgtacggggactacggtaactttccaccgttctaccgtacctacgttaccacgtccgacggtccccgttggaacccggtagggaccgttaggaaacgggtcttaggggtcgggttaacttaaggtttttaacttcgttcggtaacgaggttaccttaaaacgtttttctttttttaccgttaccctttcccgttttaccgggtcgggttaacccggtttccgggaacccgtaagggggaaccctaggggtacgtaaacgtccgtaaaggaccgtaacgttggacggttcgtacgcctaaccgtntttaccggtcttagttcccg

SEQ ID NO: 45010 - DNA, 790 bp, Homo sapiens
  misc_feature: GYAE6OF02ITJ5Y.19.67.G01.1.454.CMB.1.raw
  modified_base (119)..(119): a, c, t, g, unknown or other
  misc_feature (119)..(119): n is a, c, g, or t
  modified_base (128)..(128): a, c, t, g, unknown or other
  misc_feature (128)..(128): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
  modified_base (718)..(718): a, c, t, g, unknown or other
  misc_feature (718)..(718): n is a, c, g, or t
tcagtactctcgtgcacgaccggtgctcgatttagagtatacatattggggtttgggggggagaggagcccagcactgggattccgaggtgtttccattcggtgctcagcactgaaacnaggacgtcncactagtggttagttcgcgtacgtacggtttcggttttcctcgcgtcgtaacttaacgtttacggaagggtggttccgtaccgtaggttggtagggacggtacaacctaacgggttgggtagaacgtaccgggtggggaacgggtacggttcgttaccgggaccacgtccggtagggaccggtcggtctagaggtacggtctcgtcgtacgtaccgtaacccgttggtccgggtccttcgacgacgacgtacgtcgtacgttagttcgtccggtccgggtcgggtcccaacggtcgtacccgaacgggaagggtaaacggccgggtaaccggggtggttccgggaccgtaggttaaggttttagttttagggagggtacgacgtaatcgttaacggagacgtaccngtaagggngggacctacgtactacgactactcgacgtagtacttactttcgaactacgaactactcgtacttcgtactaaactagtaacgtacaaccgtcgacgggacggaacccggacgtaccggcccggttacgttaacttacggttagttacggtgttaacgaggtttaacggtttacggnggtaaccggttggtccgttagggttaggaacgtcggtaagttacgacggttaccgggacggggtaaccccgg

SEQ ID NO: 45011 - DNA, 628 bp, Homo sapiens
  misc_feature: GYAE6OF02GCQE1.19.67.G01.1.454.CMB.1.raw
  modified_base (240)..(240): a, c, t, g, unknown or other
  misc_feature (240)..(240): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttccnccacctccaaagaaacaaaaacttcttacgcctaggtaaccaacgagacgaccaggacacgccctacctaagttcgctctatttacgtgggtcttctacggcgacgtaacgttccggggtcctggacccgtagttccggggctacggcgggtctaggggacaggtactttcacctctaccacctatccagcacgtcctgcaggtctagaagacttggtcggcttaaggttttaattacgtcggtacaacggtacttaacttttattttttcctaacgttcccgttacggttcggtaccggttacggacccgtaagggtcccgtaagggtacgtaaactcgaaggaaccgtacgttgggacggtctaccggacctacgtactcgttccg

SEQ ID NO: 45012 - DNA, 740 bp, Homo sapiens
  misc_feature: GYAE6OF02IWZUQ.19.67.G01.1.454.CMB.1.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
tcagtactctcgtgcacgaccggtgctcgatttagagtatacatattgggtttgggggggtaggaggagcccagcactgggattccgaggtgtttccattcggtgctcagcactgaacacagaggactcaccatggagttttggctgaccttgggttttccttgctgctaatttcaggaggtgtccagtgtgaggtncaacgtggtggagactgggcggaggcttggtcagccgtgggcggtcnctgagctgtctgtcgaaccctcgtggtctccgtcagcagcacgtgtnttcgccgttcgggccgtccgacggtccgtaccgaaggggaacggtacggggcccggtaggtcggggtccgacggttagggttttaatttttaggaaggggtttcgggaaacggtcgttaacgtttaccggttaaccggggaaacgttacccgttacccgaaggttacgggggacgggtacccgtacgtttaccgacccttacgtcgtacccgagtaacgtcctttttacacgtacaaacacctacgtcgttcgttacttactaaactacggaacctaagtacccgtagggacccgggttaccggaacggtacccgaaccggggtccttaaccggtttactttacggttggttaggtacgtaggttagtttaggtcgggaaggtacgttcgggttacggtgggttgtaacggtacgtagtacggtaccggttacggggacccgtaacggg

SEQ ID NO: 45013 - DNA, 725 bp, Homo sapiens
  misc_feature: GYAE6OF02HR654.19.67.G01.1.454.CMB.1.raw
  modified_base (238)..(238): a, c, t, g, unknown or other
  misc_feature (238)..(238): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtacccagactcactgctgtgtctctgggcgagacggccacaatcaactgcaggtccagccagaactacttttcncccacctaccaaagaaacctaaaaactttccttaacgcctacggtaaccaaacgagacgaaccaaggaccacgcccttacctaagttcgcctctaattttacgtcgggtcttcgtacgcgcgtaagttccggggtcctagacccggtagttccggggcaggtccgggtcgtcgggaactgtactttcgactcctaccgaaccctatccgaacgtcccgaagtcccgtacgaccgacggtaccgtaggaaaccgtagttcgggtacgttaccgtaaggttttttacttacgttacggttaccgaacgttaccttaaatttttacttttttttaccgttaaccgtttcccgttacccgggtttagggtaaccccggtttccgggaacccgggtaacggggtaacccggtacgggggtttaaccgaaacgtccggtaaacgtaacggttaaccgtggtcggtctaccgacccgtaacgtcttacgttccg

SEQ ID NO: 45014 - DNA, 761 bp, Homo sapiens
  misc_feature: GYAE6OF02H3SOS.19.67.G01.1.454.CMB.1.raw
  modified_base (293)..(293): a, c, t, g, unknown or other
  misc_feature (293)..(293): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggagtttttggctgaccttgggttttccttgctgcaatttcgaggaggtgtccagtgtgaggtgcaacgtggtggagacgtgggcggaggtcttggtccaggccgtgggcggtctcgtgagtactcgtccgtgtacgacccgtgtcggggtcctccgtcngcagcgtactgttattcgccgttcgggtcccgcgacggccgtaccggaggggaacggacgggaccgggtagggtcgggtaccggacgttaaggttttagtttttaacggagggtcggggaaccgtacgtacgtttacgtaacggacgtacttaccgagtcggggtaacggtccgtacgttaccaccgttactccgtaccgtacgttaacgtttaccttttaccgacaaacggtaacctaaccgtacttcgtaccttaacttaacgtaaagtacgtaaccgtacgtaccggtacgggaccgggtaccggaacgggaaccgcccgggttaaccgttacgttttacgttagtttacggacgggttagttaacggttagttttgggacggttaacggcggttgggtacggttgggtacgtaacggtcggtaacgttaccggacggggttccggggaacccggtaacccgggg

SEQ ID NO: 45015 - DNA, 712 bp, Homo sapiens
  misc_feature: GYAE6OF02ICNFV.19.67.G01.1.454.CMB.1.raw
  modified_base (92)..(92): a, c, t, g, unknown or other
  misc_feature (92)..(92): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (455)..(455): a, c, t, g, unknown or other
  misc_feature (455)..(455): n is a, c, g, or t
  modified_base (537)..(537): a, c, t, g, unknown or other
  misc_feature (537)..(537): n is a, c, g, or t
tcagtactctcgtgcacgaccggtgctcgatttagagtatacatattgggtttcgggggagctacaacagcaggcaggggcagcaagatggngttgcagacccaggtcttcatttctctgttgctctggatctctcggttcctgcggggacatcgtgatcgacccagtacccagctcactggactgtcgtctcgtggggcgagaccggccaacaatacaactgcacggtccaagaccaagtaacttactttttcacccgaccttaccgaaagaaaacctaaaaactttccgtaagacctaggtaaccaaacgagaacgaccagggacagccctaacgtaagttcgactactatttaccgnggtcttacgtacgcgtacgtaacgtccgggtacctggaacccgngttccggggacaggtccgggtatacggggactagtaactttcaccgttacncgtaccagtcacggaccaggtcctgacgacgggcgtaagaacggtactgggtacggtaccgttaagttttaacgttaccgtntaaccgagttacccaaagttttttcttttaccttaaccttccggttaacgggttcgtaacgggttaccggacccgtaaacggggacccgttaaggggtaccgtaaacgttaccgaagggtaacccgtaaagtccgggtaagccgttacgaacccgtaacgtaccttggttacccg

SEQ ID NO: 45016 - DNA, 846 bp, Homo sapiens
  misc_feature: GYAE6OF02II7CA.19.67.G01.1.454.CMB.1.raw
  modified_base (237)..(237): a, c, t, g, unknown or other
  misc_feature (237)..(237): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctgatctctggttcctgcggggacatcggtgatcgacccagtacccagactcacgtggctgtgtctcgtgggacgagcggccacaactcaacgtgcgaggccacgccaaggtaaaccntttttccgacccaccttacccaaaagaaactaaaaacttaccgttaacgccgtacggtaaccaaaccgagaacgaacccgaggaaccgtacgaccccgttcctaaacggttcacgttaccgtatttaacccgtgggtcctttacgaaccggtcgtaccggaacgttttaccccggggtccctacgggtaccgtaaccggtttcccggggcggaacgggttacccgggggttcgttaaccgggggactaaaccgggtacgttttttacccgaacccttttaccgtacccgtaaccggaactttaccggacggtacctaccgggtacccgtacgggaccgtaacggtccggtaaacgtaaagttcgtacggtagggaccttaggtttttaaaccgtgttccgtaccgaaggtttacccttaaaagtttttcgttttacccttttacggtccccgttaaccggtcggtttaccggggtttcccgaacccgttaaacgggggttacccagggggttaacgttaaacgtaccgaacgggtttaacccgaaccgggtttacgttacgggccgttacgaccgtaacccgtctttaaccgttcgttacgttttaccc

SEQ ID NO: 45017 - DNA, 598 bp, Homo sapiens
  misc_feature: GYAE6OF02IDYWX.19.67.G01.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttcnccactccaagaacaaaaacttcttagcctgtaccaacaganacaggacagcctctaagttgctcatttactgggcttctacgcgcgaagttcggggtccctggaccgtagttccggggcaggcggtctgggacagtatttcactctcaccatcagcagcctgcaggctagaagtagtggtggctaagttttattacgtgtacgagtactaaatttctttttacgttaacttcccgttccggttcggtaaccggtttcgggacccgtaaacggggtacccgaggggttaacggaaacttccgaacggtaacccgtaaacgttgggtacggtcgtacggacccgtaacctagttccgttacg

SEQ ID NO: 45018 - DNA, 694 bp, Homo sapiens
  misc_feature: GYAE6OF02GFHFM.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaacgtggtggagacgtggcggaggcttggtccagccgtgggcggtctctggagactgtcctgtacgaccctcgtggggtctccgtcagcagcgactgtattcgcctcgggtcccgccgaggcctaccggagggaagacgggccggaggtcgggtcggcgtagggttattttagtacgggtggacgactagtttacgtaacgggagtaccgtccgagtcggggacgggtccgtaattccgacctatccgtaccgtagtacgttacctttttcacaacggtaaacccaactacgttcgttccttaccgtttaacaaaacgttacgaaccgtacgtacccgtagggaccgggaccggacgggaaccgtaccgggtccgttaacttagtttaacgttggttagtacggtagttacgtttaaggtgggtaacggtaggttcgggtacggtaggggtacggtacgacgtacgttacggtaccgggtccggggacccgtaaccgggg

SEQ ID NO: 45019 - DNA, 751 bp, Homo sapiens
  misc_feature: GYAE6OF02IARZD.19.67.G01.1.454.CMB.1.raw
  modified_base (282)..(282): a, c, t, g, unknown or other
  misc_feature (282)..(282): n is a, c, g, or t
tcagtactctcgtgcacgaccggtgctcgatttagagtatacatattgggtttgggggggtaggagggagcccgagcactgggattccgaggtgtttccattcggtgctcagcactgaacacagaggactcaccatggagttttggctgacctgggttttccttgctgctaatttcgaggtagtgtccaggtgtgaggtgctaacgtggtggagacgtggccgggaggtcttcgggtcaggccgtggggcgtctacgtgagtactgtcctggcgtacctcgngggtctccgtcagcagcgacgtgttagttcgccgttcggggtcccgtcgacggtccgaccggaacggggaaggacggtacgggacgggtgggtcggaccggtaggtttacgttttttaggacggggtaggggtaaccggtaactagttttacggaacgggacgtaacgtccgtaggtacggggacgggtacggtacttccgaaactcttacccgtcaacggtacgttacctttttacactaacggaaacgaacctacgttacggtttcgtaacttaccgtaaacttaacgaaaccgtacggtaccgtaccggagggacccggaggaacccggtaccgtccgggtaccttaaagtttacgtttggtaggttacgtaaggttacgttacggttcggtacggtaaggtcggtaaccgggtggtaacggtacgacggtacgtaccgtacgggtccggtaaccggggacccggg

SEQ ID NO: 45020 - DNA, 735 bp, Homo sapiens
  misc_feature: GYAE6OF02FSO4X.19.67.G01.1.454.CMB.1.raw
tcagtactctcgtgcacgaccggtgctcgatttagagtatacatattgggtttggggctgggagaggagcccagcactgggattccgaggtgtttccattcggtgctcagcactgaacacagaggactcaccatggagttttggctgacctgggttttcctgctgcaatttcaggaggtgtccagtgtgaggtgcaacgtggtggagactgggccggaggcgttggtcccagcccgtggggccggtctcgtgacgacctgtcctgtcgaaccctcgtgggtcctcgtcgagcagcgtactgtattgtccgtcggggtccgcccgtaggccctccgaagggggaacgacgggacccgggaaggttcggggaccggacgtaacgggttattttttaagtacggggtagggtaccggtactaggttaccgtaacgggacgtaactcccgaagtcggggacgggaccgtacttcgaacccaagttcctacccgagacgtacctttttcacgtaacgtaaccaacaccgttatccgtttaccttacaaacgtacggtaaacctaacgggccttacgggaacgggtcccgaaggtaaccgacccggggttaacctttccggtaaatttacgttcggttagttcgaacggttacggttttaagttcgggaccgttaagttccggggttaattacgggggttcggaaaccgtaacgggaacctttccggaacggttccggggg

SEQ ID NO: 45021 - DNA, 662 bp, Homo sapiens
  misc_feature: GYAE6OF02I38CH.19.67.G01.1.454.CMB.1.raw
  modified_base (450)..(450): a, c, t, g, unknown or other
  misc_feature (450)..(450): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgaccttgggttttccttgctgctaatttcaggaggtgtccagtgtggaggtgcaacgtggtggagacgtgggcggacggcttggtccagccgtgggcgtctcgtgacgctgtcctgtcgtaccctcgtcgggtctccgtctacgcagcgactgtattcgtccgtcgggtcccgcgacggcctaccggagggaaggacgggccggaggtcggggtcgtacgtaggtttagttttagacggggtacggtacgtacgtaagttcgtaacggacgtactaccgtaggtgggacggtcgtacgtaccacctntcccctacgagtacgttcctttcgtaccaacgtacaccgtacttcgtacttactacaaacttcgaacgtccgtacgtggaccgggtacccggaggaccgtaccggtcgttacgtttaagttgttagtgtacggtagttacgttgtacggtacgtaggtccgggtcgttagggtacgtacgtaacgtacgtcggtaccgggtcgggtacccgg

SEQ ID NO: 45022 - DNA, 681 bp, Homo sapiens
  misc_feature: GYAE6OF02HCLWM.19.67.G01.1.454.CMB.1.raw
tcagtactctcgtgcacgaccggtgctcgatttagagtatacatattgggggtttggggagaggagcccagcactgggattccgaggtgttccattcggtgctcagcactgaacacgagaggactcaccatggagtttggctgacctgggttttcctgctgcaattcaggagtgtccagtgtgaggtgcaacgtggtggagtacgtgggcggaggcttggtccagcctgggcgtctcgtgagtctggtacctgtacgaaccctgtcgggtctcgtcagcagcgctgtatcgcctgggtcccgcgaggtcctccgagggacgaggccgggagtgggtcgcgtaggttagttttacgagggtggacgtactagttcgtaggtacgtactcgagttcgggacggccgtagtccactataccgtacacgtacgttactttcgtcgaagaactacgacttgtaccttacttacgtaaagttcgaaacgcgttaccgtaggaaccgggtccgtaacggtaccgtaccgggtcccgttaagttacgtttaaggtttcggtaacgttacgggtaacgttacgggtttacgtacgggtcggttaacggtacggggttaccggttagggtacggtaacgacgggttaccttacccgggtaaccgggttcggggtaccccgtaaaccggggg

SEQ ID NO: 45023 - DNA, 705 bp, Homo sapiens
  misc_feature: GYAE6OF02HGL2K.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactgggcggaggcttggtccagccgtgggcggtctctgagactgtcctgtcgaaccctgtgggtctccgtcagcagcgactgtacttcgccgtgggtcccgccgaggcctccgagggaacggacgggccgggaggtcggggtcgcgtaagggtttagtttttaagtagggtcggggaacgtactagtttacgtacgggagtacctaccgaggtggggacgggccgtaacttacacccgtatcctaccgaaggacgtttacctttttacgacgaacgtaaaccacctacgttgtaccctttcttaactaaaacgttcgaaacctacggtacccgtgggaaccggggaccgaacggggaacccgaccggggtccgttaacctttagtttacgttcggttagttacggtaagggttagttttacggtcggggacgtaaggtggggtaccgttggggtacgacgtagtacgttaccgacgggtaccggggacccgtaaccgggg

SEQ ID NO: 45024 - DNA, 669 bp, Homo sapiens
  misc_feature: GYAE6OF02J1ZPW.19.67.G01.1.454.CMB.1.raw
  modified_base (279)..(279): a, c, t, g, unknown or other
  misc_feature (279)..(279): n is a, c, g, or t
  modified_base (639)..(639): a, c, t, g, unknown or other
  misc_feature (639)..(639): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcattcaggagtgtcagtgtgaggtgcaactggtggagactggcggaggcttggtccagccgtgggcgtctcgtgagtactgtcctgtcgaacccgttcgtggggtcctccggtcncgcgagcgtactgtattcgtccgttggggtcccgccgtacggccgtaccggacgggaaaggcgggccgggaggtcgggtcgacgtagggtttactttttaggacggggttagggacgtactaagttcgtaacgggacgtactccgagtacgggacgggccgtagttaccaccgtaacttccgtaccgtaagggacttaccgtttttccgtacgacgtaaaccgaccgtacgttcgtacttacgttacaaagttcgaactggaccgtggacgggtacgacggcgacggtacctcgttacttagtcgtgtcgagttcgttagtcggtacggtgtcggtacgttgggtacgtacgttaacggnttaccggacgggttcggaccggtaaccggg

SEQ ID NO: 45025 - DNA, 763 bp, Homo sapiens
  misc_feature: GYAE6OF02HDB8D.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatgggtagttttggctgaccgttgggtttttccttgctgctaatttcgaggaggtgtccagtgtgaggtgacaacgtggtaggagacgtgggcgggaggtcgttcggtaccgaggcccgtggggccggttcctcgtagagtacctgtccgtggtacaaccccgtcggttggggttcctcccggtcaggcgcgacgtagtgttacgttcgtcccggtgggtcccgacgacgtccgtacgagggaggacgggccggtaggtcgggtcgacgttaggtttaagttttacggtaggggtagggaccgaagtacgtttacggaacgggacgtactccgtaaggtacgggacgggtccgtacttccgaaccgtacttccgaccgtagtaacgttaccgtttttacacgtaacgtaacacgttaaccttcggttaccttccgttaaactaaacggttaccgaaacgtacgttccggtacggacggggtaccgggaacggtaacccggaccgggttaccttacgtttacgtttaagttcgtaggttcgtaaggttagtttacggtcgggtacggtaggtcgggtcggttacggtaggtacggtacgtagtaccggtacgggtaccggacggtaacccgggg

SEQ ID NO: 45026 - DNA, 673 bp, Homo sapiens
  misc_feature: GYAE6OF02IZFU8.19.67.G01.1.454.CMB.1.raw
  modified_base (285)..(285): a, c, t, g, unknown or other
  misc_feature (285)..(285): n is a, c, g, or t
  modified_base (473)..(473): a, c, t, g, unknown or other
  misc_feature (473)..(473): n is a, c, g, or t
  modified_base (601)..(601): a, c, t, g, unknown or other
  misc_feature (601)..(601): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatgacccagtaccagactcactggctgtgtctcgtggcgagacggccacatcaactgcaggtccagccagaactacttttccaccacctaccaaagaaacctaaaactttcctagacctaggtaaccaanagacgaccgaggacacgtcctacctaagttcgcttctactttacgcgggtcctttactacgacgacgttaacgttccggggtcctacgaccggtacggttcccggggacacggtacgggtcgtacggggaactacgtaactttccgaccttcctaccgaccctacgtccgacgtacaacgtcccggtnacccggagggttccgaaggaacgtacgttggtcgggaaactttggttaacttacgttcgacacgttactaacttttcgttttccttaacgtccgttcgtcggttacggtacgtacggaacggtacggnggtaacggtaataccggtacgtaacgtaaccggttgtacggtaccgtcggtaccaccttagtccggttaccg

SEQ ID NO: 45027 - DNA, 683 bp, Homo sapiens
  misc_feature: GYAE6OF02H9781.19.67.G01.1.454.CMB.1.raw
  modified_base (432)..(432): a, c, t, g, unknown or other
  misc_feature (432)..(432): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggtttttccttgctgcaatttcaggaggtgtccagtgtgaggtgcaactggtggagactgggcggaggcttggtccagccgtgggcggtctctgagacttcgtctgtacgaacccttcgttcggggtcctccgtcacgcagcgacttgtacttcggccgttgggtcccggccgacggtcctaccggaagggggaacggacgggccgggaagggtcgggtcgcggtacggttaattttttaggtagggttcggggaacgtacgtatttaccgacgggtaacnccgttacgagtagggtacgggccgtacttccaccgtacttctaccgagtacgtacttttctacgaacgaacctactacgtgtacttaccttacaactagaacagaccgtagggacgggccgacggaccgccggtcgttactagtttagttgttagtagtacgtagtttcgtacggtgtaaggttcgggtacggttggtacggacgtaacgtacggttaccggtacggtaccgggggaccgtaacccggggg

SEQ ID NO: 45028 - DNA, 703 bp, Homo sapiens
  misc_feature: GYAE6OF02I07LN.19.67.G01.1.454.CMB.1.raw
  modified_base (203)..(203): a, c, t, g, unknown or other
  misc_feature (203)..(203): n is a, c, g, or t
  modified_base (461)..(461): a, c, t, g, unknown or other
  misc_feature (461)..(461): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagttgtgaggtgcaacgtggnggagacgtggcggaggcttggccagccgtgggcgtctcgtgagactgtccgtgtcgaacccgtcgtacgggtcctcgtcagtcagcgacgtgtagttgccgtcgggtccgaccgagccgtcgagggagcggcggagtcgggcgcgtaggttacttttagtagggtggacgtacgtatcgtacggagtacgtaccgtagtcgggacgggtcccgtattccgaacccgtattccgtacccgaagacgtacgtttttaccncgtaagaaccgaacctacgttcggttaccttacgtttactaaatacggaaaccgtacgtccttaagggacgggtacccggaacggccgtaaccgggtcccgttattaacgtttacgttgttacggttaggacggttaaggtttacggttaccgggtacgtaaccggttgggtacgtttggggtaagttaccggtaacggtacggttaccgaaccgggttacggggacccgtaaaccgggggg

SEQ ID NO: 45029 - DNA, 776 bp, Homo sapiens
  misc_feature: GYAE6OF02HCEAT.19.67.G01.1.454.CMB.1.raw
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (465)..(465): a, c, t, g, unknown or other
  misc_feature (465)..(465): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgaccgttgggtttttcctgctgctaatttcgaggaggtgtccagtgtgnggtgcactggtgagacgtggcggagcttggtccagccgtgggcgttcncgtgagaccgtgtcctaggtcgaacccgttcgtcgggtcctccgtcacgcagcgacgtgtattcgccgttcgggtcccgccgaggccgtccgaagggacggacgggccggaggtacgggcgtacgtaggtttagttttacggtagggtacgggacgtaacgtacgtttccgtacgggaacgtacctacccgagtacggggacgggtccctaagttacccaaccgtnttacccgtactacgggtacgttaacctttttccgaaccgtaacgtaaacccgtacgtaccgttcgttaacccttacgttaaccgtaaacgttacggaaaccgtacgggtaccgtacggggtaacggggtacccgggaacgggtaacccggaccgggtacccgtttacgtaacgttttacgttacggttacgttacgtaggttaacgttttaggttaccgggtcgtaacggttcgggtaccggttagggttccggtaaacgttacggtacgtttaccggtaaccggttaccggggacccggtaaacccgggg

SEQ ID NO: 45030 - DNA, 869 bp, Homo sapiens
  misc_feature: GYAE6OF02I6086.19.67.G01.1.454.CMB.1.raw
  modified_base (298)..(298): a, c, t, g, unknown or other
  misc_feature (298)..(298): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctggttttcctgctgcaattcaggagtgccagtgtgacggtgacaacgtggtcggaagacgtgggtcggaggtccttggtccagtccggtgggccgttctcgtgacgtacgtcgtccgtggtcgaaccccttgtcggggtacctccgtacgngcgagcgtaacgtgtacttggcccgttgggcccgccgagtccgtacgaaggggacggacggccggaggttcgggcgacgtaggtttactttaggacggtcgggtaaccctagtagtttccgtacggacgtacctacgagtacgggggtaaccgggcccttacgttaacccacccgtaatccgtaaccgtaggtaacggtttacctttttaccgacgtaaaccggtaaaccgtacgttaaccgttacggtttcctttaacccttaacggtaaaaccgttaaccgggttaaacccaccggggttacccgtacgggggtaccgggggtaaacccgtaacggggtaacccgtaacccggggtacccgtttaaccggtttaagttttaacgggttttcggtaacggtttaaccgggtaaacggttttacggggttttaacgggtaccggttaaacggggttaccgtttggggttaccccggggtttaacggggtttaaggtaacccggttacggtaaaccggttaccccgggtaaccggggtttaaacccgggccccgggggttaaaaaccccggg

SEQ ID NO: 45031 - DNA, 704 bp, Homo sapiens
  misc_feature: GYAE6OF02IHMRR.19.67.G01.1.454.CMB.1.raw
  modified_base (176)..(176): a, c, t, g, unknown or other
  misc_feature (176)..(176): n is a, c, g, or t
  modified_base (295)..(295): a, c, t, g, unknown or other
  misc_feature (295)..(295): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttcctgctgctaatttcaggnggtgtccagtgtgaggtgcaacgtgggtggagacgtggcggaggtcgttggccagccgtggggcggtctcgtggacgtacttcgtctgtcgtaaccctcggtgggtcctccgtcagtcngtcgactgtattcggccgttcgggtccgccgtacgggccgtaccggaagggggtaacgcgggaccgggtaggttcgggtcggacgttaagggttttactttttaaggacggggttagggaaccgtacgtagtttaccgtacgggacgtacctcgaggttcggggacggtcctagtccaaccgtntccgtacaggtacttacttttcganagtaactcgtacttgttactaccttaacaaacgttcgaaacgtcgtccgtacggacgggtaccgtaaggacccgtaccggtcgttaccttaagtttacgttcggtgttacgtaagttagtttagtacgggtaagttcgtagggtcggtaggtaggaacgtaggtaacgttcggaccgggtaccgggaaccggtaaccggg

SEQ ID NO: 45032 - DNA, 688 bp, Homo sapiens
  misc_feature: GYAE6OF02HWR58.19.67.G01.1.454.CMB.1.raw
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
  modified_base (468)..(468): a, c, t, g, unknown or other
  misc_feature (468)..(468): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaattttcaggaggtgtccagtgtggaggtgcaactggtggagactggcagaggtcttggccagccgtgggcggtctcgtgagactgtcctggtcgacccttcgtcggggtctccgtcgacgcgagcgacttgtattcgtccgtcggtccgaccgtggcctaccggagggaaggacggccgggagtcgggtcgacgtaggtttacttttaggnggtacggacgtactagttacgtacggtanaccgtccgagtgggacgggccgtacttacgacctacgtcctacgtagtacgttacttttccncgaactaaccgactacgtacgttcccttaacttacgaaacttacgaaacgtccgtaccggtcgggaacgggtaccaacggggtaccaacccgggtccgttaaccgtttagttaacgttggttacgtaggtaccgtttaggtttacgtacgggtcgtaacggttccggtacggtgggttacgacggtaagtaccggttacgaccgggtgggtaaccccggg

SEQ ID NO: 45033 - DNA, 770 bp, Homo sapiens
  misc_feature: GYAE6OF02HYRKZ.19.67.G01.1.454.CMB.1.raw
  modified_base (420)..(420): a, c, t, g, unknown or other
  misc_feature (420)..(420): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctggcggggacatcgtgatcgacccacgtacccagactccacgtggctgtgtctcgtggacgagccggaccacaactacaactgcgacggtccagaccaagtaacttacttttccaccacctaccaaagtaaaacctaaaactttcgtacgaccgtaggtaaccaacgagaacgaaccgaggtacacgtacctaccgtagtcgtacttatacgtttacgtcggtcttacgtacgccggtacgtaaccggtttcccgggtccctaggtacccgtagggtcccggganacgggtcgggtcgtacggggaactagttactttccactcctaccaccgtataccgacgacgtacgccctgggtacgacggttcgtaaggaaagtacggttggtacgttacctttaaggttttacgtcccgttagtaccaggttaacctttagtttttacccttttttacgtacccgtttcccggttaccggttacgggtaccggtttaaccgggaccgttaaacggggttacccggggtaagggttaacgaaacgtttaccggaagggttaaccgtaacgggtttacgggacggttcctacggaacccgttacccgttaacggtttcccgtttacgtcccgtttaacccg

SEQ ID NO: 45034 - DNA, 747 bp, Homo sapiens
  misc_feature: GYAE6OF02FNNO5.19.67.G01.1.454.CMB.1.raw
tcagtactctcgtgcacgaccggtgctcgatttagagtatacatattgggtttgggggggaggaggagcccagcactgggattccgaggtgtttccattcggtgctcagcactgaacacagaggactcaccatggtagttttggctgaccttgggtttttccttgctgctaatttcaggaggtgtccagtgtgaggtgcaagtggtggagacgtgggcggaggtcttggtccagccgtggggccggtctcgtgagtactggtcctgtcgtacccgtcgtcgggtcctccgtcagcagcgactgtattcgccgtcgggtccgccgacgctccgagggaacggagggcggaggtgggtcgcgtaggtttattttagtagggtagggacgtagtacgttacgtacggtacgtactccgtagtacggggacggccgtattaccacctatcctccgaagtacgttacttttctacacgtaaaccgactacttcgtaccttcgtttaacaaacgttagaaacctcggacccggttagggaaccggggacccgggtacggaaaccggtaccgggttccccgttaagtttaacgttttacgttacggttcgggtaacggttaagggtttacgtttaggttacgggtaccggtaagggttttacggggtaccggtttacggggtagggtaacccgtaaaggtttaccggtacccgtacgggggttaacccggggtaccccgggtaaaccccggggg

SEQ ID NO: 45035 - DNA, 762 bp, Homo sapiens
  misc_feature: GYAE6OF02GCB9W.19.67.G01.1.454.CMB.1.raw
  modified_base (237)..(237): a, c, t, g, unknown or other
  misc_feature (237)..(237): n is a, c, g, or t
  modified_base (316)..(316): a, c, t, g, unknown or other
  misc_feature (316)..(316): n is a, c, g, or t
tcagtactctcgtgcacgaccggtgctcgatttagagtatacatattgggtttgggctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtntctgagactgtcctgtgaacctctggggtctccgtcagcagcgactgtattgcctgggtccgcaggctccgagggaagnggccggagtgggtcgcgaggttatttttagagggttgggacgtacgtagtttccgtaacgggagaccgtccaagttggggacggggcccgtaagtttccgaaccctaagttcccgtcccgtaaggtaacggtaacctttttttaccgccgtaaacggtaaacctaaccgtaccgtttaggttaccttaccgttttaaccgaaaaagtttcggaaaacctacgggtacccttagggaaccgggggtaccccgaaacgggggtaccctaacccgggggtccccggtttaccgtttaaaggtttttaacgtttcgggttacgggtttacgggtaacggttaaggttttttaacggtcgggggtaccgtaaggtttcggggtaacccgtttgggggttaaccggtaaccgtaacgggtaaccgtttaccggaaccggtttaccggggggg

SEQ ID NO: 45036 - DNA, 710 bp, Homo sapiens
  misc_feature: GYAE6OF02H9OW2.19.67.G01.1.454.CMB.1.raw
  modified_base (669)..(669): a, c, t, g, unknown or other
  misc_feature (669)..(669): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgctaatttcgaggtaggtgtccagtgtgaggtgcgactggtggagacgtggcggaggcttggtccagccgtgggtcggtctcgtgacgtcgtgtctgtcgtaccgtcgtcgggtcctccgtcgagcagcgagtgtagttcgccgtcggccgtcgcggtcctacggagggaaggcggacgggtaggtcgggtaccgtacgtaggtttagttttaggtaggtacggacgtactagttcgacggtacgactcgaagtgggacgggtacgacttaccgacctacgttcctacgagtaccgtttacttttccgacaaccgtaaacacgtaaccgttcgttacctttaccttaacgtaaagtaggtaaacccgtagtacccgtagggaccggggtacccggaacggtaaccggtacccggttacccggttactttaagtttagttacggttacgtaggttaagtttaggtttacggtacggtagtacgggttggtacggttacgggaggtnaacggtcgttacggaccgggttccgggaccgtaacccgggg

SEQ ID NO: 45037 - DNA, 721 bp, Homo sapiens
  misc_feature: GYAE6OF02FREB4.19.67.G01.1.454.CMB.1.raw
  modified_base (354)..(354): a, c, t, g, unknown or other
  misc_feature (354)..(354): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatgggagttttggctgacctgggttttccttgctgcaatttcaggaggtgtccagtgtgaggtgcaactgggtgagactggcggaggcttgggtccagccgttgggccggtctcgtgaggtactgtaccgtgtacgaaccctcgtggggtctcccgtcagcaggcgactgtatgcctgggtccgccgaggctccgagggaacggaggaccggaggtagggtcgngtacggttagtttttagtaggtgggacgactagttacgtacggaagactccgaagtaggggacgggtcccggtattaccaaccacttacctaccgtaaggacgttaccttttcgtactaaggtaaacctacaacttcgtacccttactttaccgaaaacttacgggaaaccacggtacccgtagggaaccggggtacccggtaaggggacccggacgggttaccccgttatttaaccgtttaagttcggttacgtaggttacgttaggtttaacgtaggggtaccgtaaggttacgggtacgttaggggttacggtacgaggttaacggttacccgtaagggtcccggggaccggtaaacccggggg

SEQ ID NO: 45038 - DNA, 911 bp, Homo sapiens
  misc_feature: GYAE6OF02GJ5GH.19.67.G01.1.454.CMB.1.raw
tcagtactctcgtgcacgaccggtgctcgatttagagtatacatattggggtttgggggggagaggagcccagcactgggattccgaggtgtttccattcggtgctcagcactgaacacagaggactcaccatggtagttttggctgaccgttgggttttccttgctgctaatttcgagggtacggtcgtccgtaggttggtaggtagggtgaccgtaacgtgggtaggaggtaccggtcgggaccggggaggtccgtttcgggtcccaacggtcccggttgggggtccggttccgttaccgtagggtacggtaccgttcggttcccgtacggttcccggtaaccccgttcggttccgggggttcccttccggtacgaacggcgtaccggacgtacgttaggttacgtttcggtcccgggttcccggggtccccggtcccgggtacgggcccgttaaccggggaacgggggaaacgggaccgggggtacccggggtagggttcgggggtaccggaccggtttaaagggttttaacggttttttaacgggttaggggtacggggtaaccgtaagttacggtttaccgggtaaccgggtagttacccgtaccggtaggtacggggaacggggtccgtaacgttaccaccgtaactcctaccgtaggtacgtttaccgttttcaacggaaccgaaccgtaacgtacgttccgttaccttactttaaccgtaaagttaccgaaccgtacggtccgtaacgggacccggggaccggtaaccggtaaccgggccgttccgttaagttaccgtttagtttggtaaggtgtaaggttaggtttagacgggtcgtaggtacgggtgttaccggaggacgtagttaccggacggtaccgggtccggtaccggtaacccggg

SEQ ID NO: 45039 - DNA, 649 bp, Homo sapiens
  misc_feature: GYAE6OF02F3UMO.19.67.G01.1.454.CMB.1.raw
  modified_base (616)..(616): a, c, t, g, unknown or other
  misc_feature (616)..(616): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggagtgtccagtgtgaggtgcaacgtggtggagactggcggaggcttggccagcctgggcgtctctgagactgtcctggtaccgaacccgtcgttggggtcctccggtcagcgtagccggtaactgttagttcgccgtcggggtcccgccgtaacggccttcccgaagggaacggtacgggccgggtaaggtcggggtccgcgtacggttattttttaagagggttggggaccgtacgtagtttcgtacgggaagtacgtccagtggacgggccgatcgaccatccgtacagtagtacctttcgtcaacgactaacacgtctcgttcttacgaatcgaactacgcgttaggacggccggacggacgtccggccgtacttacgttacttgttggtcgtagtacgtttagtcgggacgttacgtcggtcgttagggtgaacggtanaggttcgtaccggttggggaccgttaaccgggg

SEQ ID NO: 45040 - DNA, 735 bp, Homo sapiens
  misc_feature: GYAE6OF02JL3IQ.19.67.G01.1.454.CMB.1.raw
  modified_base (183)..(183): a, c, t, g, unknown or other
  misc_feature (183)..(183): n is a, c, g, or t
  modified_base (356)..(356): a, c, t, g, unknown or other
  misc_feature (356)..(356): n is a, c, g, or t
tcagtactctcgtgcacgaccggtgctcgatttagagtatacatattgggtttggggtgggagaggagcccagcactgggattccgaggtgtttccattcggtgctcagcactgaacacagaggactcaccatggtagttttggctgaccttgggttttccttgctgctaatttcaggaggtntaccagtgtgaggtgacaagtggtaggagacgtggcggaggtcttggtccgagtccgtgggtcgtctcgtaggacgtcgttcggtcctacggtcgtaaccctggtcgggttctccgtacacgtcagacgtctgtatcgcgtcgggtacgccgtacgcctaccggagggtacgngggtccggtaggtcggggtactcggttaggttacgttttaggacggggtacgggactaacggtcgttaccgtaagggtaccgtacgtacccgtaaggtcgggtaaccggggtacccgtactttaccgaccctaacgtccgtaacgaagtaccggttactttccgaagtaaccgaactaccgtacgtagttccttaacgtactaacgtagaactacgtacgtacggtacggaccggtaacggaaccgtacccgggttctacgttagttacggttacgtgtacggtacgttaagtccgggtaggttacgacgggttcggtacggttaccgggagttaaccggtacgtaggtaaccccggtagggtcccggggtaaacccgg

SEQ ID NO: 45041 - DNA, 664 bp, Homo sapiens
  misc_feature: GYAE6OF02GDFYJ.19.67.G01.1.454.CMB.1.raw
  modified_base (347)..(347): a, c, t, g, unknown or other
  misc_feature (347)..(347): n is a, c, g, or t
  modified_base (481)..(481): a, c, t, g, unknown or other
  misc_feature (481)..(481): n is a, c, g, or t
tcagtactctcgtgcacgaccggtgctcgatttagagtatacatattgggtttggggtgggagaggagcccagcactgggattccgaggtgtttccattcggtgctcagcactgaacacagaggactcaccatggagttttggctgacctgggttttccttgctgcaatttcaggaggtgtccagtgtgaggtgacaacgtggtggagacgtagggcggaggcgttggtccagccgtgggcggtctctggagtactgtccgtgtacgaacccgtcgtcggggtcctccgtcagcacgcgactgtattcgtccgtcgggtccgccgacggccgtccgaaggggaacgngggaccgggaggtcggggtcggcgtaggtttatttttaggtagggtgggacgtactagttcgtacggagacgtaccgagtaggacggccggtacttaccgaacgtacgtcctacgtacggtacgttacttttcncgtaacgaacctactacttcgtcttaccttactaaacgtacgaaacacgtaccgtacggacggggaccgaggaaccgcggtaccgttacttacgttagtttacgtagtacggtagtacgtttagtcgggattgggtacgtcggtaggtacggtacgagtacgtggtaccggtggggtaacccg

SEQ ID NO: 45042 - DNA, 754 bp, Homo sapiens
  misc_feature: GYAE6OF02GPGUW.19.67.G01.1.454.CMB.1.raw
tcagtactctcgtgcacgaccggtgctcgatttagagtatacatattgggtttggggctgggagaggagcccagcactgggattccgaggtgtttccatcgtgctcagcactgaacacagaggactcaccatggtagttttggctgaccgttgggttttccttgctcgctaattttcgaggaggtgtaccagtgtggacggtgcaacgtggtcggagacgtggcggaggcttggtccagccgtgggccggtctcgtgagactcgtccgtgtagaccctcgtggggtccgtaccgtcgtacgacgacggcgtaacgttgtaagttcggccgtcgggtcccgccgaacggccgtaccgaaggggaacgacgggccgggtaggtcgggtcggtccgtaaggtttactttttagtagggtcggggtaactacgtagttacgttacggacgtacctacgacgttagggacgggccgtaacttcgtaacgtactccgtccgaagtacggttaccttttaccgtacaaacgtaacgtaaccctacgttacggttcctttaacgttaaacccttaaagtaaccggtaaactacggtacccgtaggggaaccgggcccggtaacgggtacggtaaccccggttcgtaaccgttttagttaaacccggtttgtgggtaagtcgtttacggttaaggtccggtaggtacggttacggtcggttacgggtacggagttacggtacgtaccgtacgggtacccgggg

SEQ ID NO: 45043 - DNA, 791 bp, Homo sapiens
  misc_feature: GYAE6OF02IH60R.19.67.G01.1.454.CMB.1.raw
  modified_base (547)..(547): a, c, t, g, unknown or other
  misc_feature (547)..(547): n is a, c, g, or t
  modified_base (559)..(559): a, c, t, g, unknown or other
  misc_feature (559)..(559): n is a, c, g, or t
tcagtactctcgtgcacgaccggtgctcgatttagagtatacatattgagtttgggggggagaggagcccagcactgggattccgaggtgtttccattcggtgctcagcactgaacacagaggactcaccagtggtagttttggctgaccttgggttttccttgctgctaatttcgaggtaggtgtccagtggtggaggtgactaacgtggtaggagacgtgggcgggaggtcttcgggtccacggcccgtgggccggtctccgtagagtctggtcctggttacgaacctcgtgggtcctcgtcgacgctaggcgacgtggttacttcgtcccggtacggggtccccggcccggtaggacccgtcggacggggtaacggcgggaccgggtagggttcgggccggtcgtaagggtttactttttaagggtagggtacgggtaccgaagtacttcggtaacggtacgtaactaccgtagggtcgggtacggggtaccgtacgttaccgacccgtacttccgtaccgaagtaccgttacttttctcgaanacctactacgtnttccttactactaaacgtactaactacggtcggtacgggtacgggacccgggtaacgaccgggtaccggggtacccttttatttaaacgtttacggtttagtacgggttaggttaacggtttagggtttacggttccggggtaacgttcggggttaaccggggtcgttagggggttacgtaaggtaacgggttaacttaccgggtaccgggttcgggggtaaacccccgggg

SEQ ID NO: 45044 - DNA, 626 bp, Homo sapiens
  misc_feature: GYAE6OF02HGYWJ.19.67.G01.1.454.CMB.1.raw
  modified_base (303)..(303): a, c, t, g, unknown or other
  misc_feature (303)..(303): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagccgtgggcggtctcgtgagactgtcctgtcgaccctcgtggggtcctccgtcagcagcgatgtattgcctgggtccnccgaggcctccgagggagaggccggagtgggtcgcgtaggttattttagaggtgggacgacgtattcgtacggagtacctcagtggacgggccgtattccacctatcctaccgaagtacgttaccttttcacgtaagaaccactacgttcgttaccttacttactaactacgaacgtacgtccgtaggacgggaccgtacggacgtaccggaccgttacgttagttgttaggagttagtaggttagtttacgtgggacgtaggtacgggtccggtagggtcgtaacgatacggtcgtacggttacgggggaccctaaccgggg

SEQ ID NO: 45045 - DNA, 825 bp, Homo sapiens
  misc_feature: GYAE6OF02GMOP3.19.67.G01.1.454.CMB.1.raw
  modified_base (175)..(175): a, c, t, g, unknown or other
  misc_feature (175)..(175): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggttttcctgctgcaatttcaggnggtgtccagtgtgaggtgcaactggtggagactggcggaggcttggtccagccgtgggcggtctctgagactgtcctgtcgacctcgtgggtctccgtcagcagcgactgtattcgcctcgggtccgtccgaggcctcccggaaggggtaacggacgggcccgggaggtgggtccgacgtagggttattttacgtagggtggacgacgtagttcgtaacggataccgtccgaagtcggggacgggtacccggtactttaccgaacccgtacgttacccgtacccgaacggtacggttaaccgtttttcccgtacgtaaaccgtaaaccgtaacctaccgttaccggttcctttaaccctttaacgtaaaacgttacgaaaacccgtacggtcccgtttaacgggaacgggggttaccccggaacggggtaacccggtaacccgggttacccggttaaccgtttaaacggttttaacggttttaccgggttaggtttacgggtaacgggtttaacgggtttttaaacgggttccgggttaaaccggggtaaacgttccgggggttacgggtttaccgggggttaacggggtaaccccgttaagggggtaaccttttacccggggaaccggggttttaacccccgggggggg

SEQ ID NO: 45046 - DNA, 1042 bp, Homo sapiens
  misc_feature: GYAE6OF02H0NO9.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtggaggtgcaacgtgggtggagactgggcgggaggctttggtccagtcccgtggggcggtctctaggacgtacgtgtccctgtacgaacccgttcgtcgggggtctccgtcagcagcgactgtattgccgtggtccgcaggcctccgaaggggaagacggaccggtaggtcgggtcgcgtagggtttaatttttacggaagggttgggacgtaaccagttttaccgaacgggagtacctccgaaggtgggtacgggaccgtaacttccgaaccgttacttccgtacccgaacggttacgtttacccgtttttttaccgtccgtaaacggttaaaccgtaacccgttaaaccgtttcgggtttaaccccgttttaaccgttttaaacccggtaaaaaaaccgttttaaccgggtaaaaacccccgttaaaacggggttaccccccgtttaaacggggggggtaaaaccccggggggttaacccccccgggtaaaacgggggggtaaaaccccccggtaaaccccccgggggggggtttaccccccttttaaacccggggttttttaaaacggttttttaaacccgggttttttacgggggttttaaaccccgggggtttaaacggggtttaaagggtttttaaccggggtttttttttaaacgggggttacccggggggtttaaacgggttaccggttttaaccgggggggttccccggggttaagggggggttttaaccccggggttaaaaccccggttaacggggtaaacgttttaaccccccccggggggttaaacggggtttaccccgggggggggggttaacccccgtttaaaaaccccccggggggggggg

SEQ ID NO: 45047 - DNA, 660 bp, Homo sapiens
  misc_feature: GYAE6OF02F1IJQ.19.67.G01.1.454.CMB.1.raw
  modified_base (402)..(402): a, c, t, g, unknown or other
  misc_feature (402)..(402): n is a, c, g, or t
  modified_base (592)..(592): a, c, t, g, unknown or other
  misc_feature (592)..(592): n is a, c, g, or t
tcagtactctcgtgcacgaccggtgctcgatttagagtatacatattgggtttggggggggagaggagcccagcactgggattccgaggtgtttccattcggtgctcagcactgaacacagaggacttcaccatggagttttggctgacctgggttttccttgctgcaatttcaggaggtgccagtgtgaggtgcaacgtggtggagactgggcggaggcttgggtccagtcctggggaccggtctcgtgagaccttgtcctgtcgaccctgtcgggggtcctcgtcagcagcgactgtatcgcctgggtcccgccaggcctccgaagggaagagggccggagtcggggtcgcgtaggttattttagaggtgggacgtcagtttcgacggagtactcgtagngggacgggccgtagttccaaccgtattccaccgtaagacgtacgttttcacaacgtaacgtaacctctcggttaccttactttaacaaacttacggaaacctacgtacccggtgggaacggggtacccggagggtaacccgaccgggtcctacttaagttacttaggtgttagtacgggttatttacggnggtacgtaggtcgggtccgttgggtacggacctaggactacgtaccggggtgggacccgtaaccgggg

SEQ ID NO: 45048 - DNA, 750 bp, Homo sapiens
  misc_feature: GYAE6OF02HD4JZ.19.67.G01.1.454.CMB.1.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
tcagtactctcgtgcacgaccggtgctcgatttagagtatacatattgggtttggggctgggagaggagcccagcactgggattccgaggtgtttccattcggtgctcagcactgaacacagaggactcaccatggagtttggctgacctgggttttccttgctgctaatttcaggaggtgtccaggtgtgaggtncaactgggtaggagacgtgggcggaggtcttggtaccaggccgtggggcggtctcgtgacgtctgtctgtcgacctcgtgggtcctccgtcagcagcgactgtagttcgccgtcgggtcccgccgagggtcctcggaaggggagcgggccggnggtgggtcgcgtaggtttattttaggtagggtagggtacgtactagttacgtacggaactcgtacgtaggtcgggacgggtcccgtattacccgtacctaacttcccgtaccgtaacgtaacgtttacctttttacgaccgtaaacgaaaccctacccgtacgttaccgttaccgtttacttaacgtaaacgtacgtaaacccgacggtaacccgtcgggaaccgggtaccgggaaccgggtaaccggaccgggttacccgttactttaaacggttttacgttaggttacggttaggttaacgggttaggttttaggtacgggttaccggtagggttacgggtaggttacggggttacggaccggttaacggtcgttacgggtaccgggttacccgggggg

SEQ ID NO: 45049 - DNA, 882 bp, Homo sapiens
  misc_feature: GYAE6OF02FV1RX.19.67.G01.1.454.CMB.1.raw
  modified_base (344)..(344): a, c, t, g, unknown or other
  misc_feature (344)..(344): n is a, c, g, or t
tcagtactctcgtgcacgaccggtgctcgatttagagtatacatattgggtttgggacaacaggcaggcaggggcaacaagatggtgttgcagacccaggtcttcatttctctgttgctctggatctctggttcctgcgggacatcgtgatgacccagtacccagactcactggctgtgtctcgtgggcgagaccggccacaatccaacgtcgcacggtccaggccaagaactacttttcctacccaccttaccaaagaaacctaaaaactttcttacgcctaggtaaccaatagacgaccgacggacacgtcccttaccgtaagttcgcttactatttaccgnggtccttcgtaccgccgtacgtaacgtttccggggtccctaggacccggtacgttccgggggctacgggtccggggttcgtacggggaactaggttacttttccgaaccgttccgttacccaacccgttataccgtacggacccgtaccggacccgttacggaccggtacgggtaccgttaagggtaaacggttacggttacgggttacgggttaccgttttaaacggtttttaacggtttacccgttttagggtaaccgtaacgtaaccgttttaaaacgttttttacgtttttttaccctttaacgtttacccccgttttacggggtttacccgggttaacccgggtttacccggggtaaccccggtaaacgggggtaaccccgtttaagggggtaaccggttaacgttaacccgggtaaacggttaacccgggtaaccgtttacgggggacccgggtaacccccggtaacccgtaacccgttaaccggttccggtttacctttaccgggtttacccctacgttttacccccccgg

SEQ ID NO: 45050 - DNA, 669 bp, Homo sapiens
  misc_feature: GYAE6OF02GKH7O.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtcgaaccctcgtggggtcctccgtcagcagcgactgtattgcctgggtccgccgaggctccgagggaagaggccggaggtgggtcgcgtaggttatttttagagggtcggggacgactagtttcgtacggagtaccttccgagtcggggaggggtcccgtattccgaaccctattcctaccgtaagtacggttactttttcgacaacgaaacgacctacgttcgtaccttaccgttaacaaaagttcgaaaccgtacgtcccgtagggaccggggtacccggtaagggacccgtaccggggcccgttacgtttagtttaacgtttggtagtaggtacggttagttttagcgggtcgtaaggttggtacgttggggtaggaactaggtactcgtacgggtcgggacccgtaaccgggg

SEQ ID NO: 45051 - DNA, 766 bp, Homo sapiens
  misc_feature: GYAE6OF02I1NK5.19.67.G01.1.454.CMB.1.raw
tcagtactctcgtgcacgaccggtgctcgatttagagtatacatattgggtttgggggagctacaacaggcaggcaggggcagcaagatggtgttgcagacccaggtcttcatttctctgttgctctggactctcgtggttcctgcggggacatcggtgagtcgacccagtacccagacctcacgtggctgtgtcgtctgggcgagaccggccacaaatcaacgtcgacgacgtccagaccaagaaacttacgttttcacctaacctaccgaaaagtaaacctaaaaactttcgttaacgaccgttaacggtaaccaaacgagaacgaaccgaacggaaccgtaacgtacccttaaccgtaaggttccgacttactaacgtttacgtacggtactttacgaccgcgtaacgtaacggtttcccgggtacctacggaaccgtacggttaccggggacgtaacgggtacccgggttcgttacgggggaaacctagggtttaactttacccgaaccgtttacccgtaccgtaaccctaggttacccgaacggaccgtacggaccgttaccggacgtacgggtaccgtaggaaacgtgttaggacgtacgttaagttacttacgtcgtacagtaacttaattctttttacctacgtccgttaccgtaggtaccgtcggaaccgacgggtaaccgtagggtaacgtaaacctacggaaaccgtacgtaacgttagtacggacgtacgtacccgaacttacgtcgttaaccg

SEQ ID NO: 45052 - DNA, 706 bp, Homo sapiens
  misc_feature: GYAE6OF02G8UWT.19.67.G01.1.454.CMB.1.raw
  modified_base (173)..(173): a, c, t, g, unknown or other
  misc_feature (173)..(173): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatggagttttggctgacgttggttttcctgctgctattcgaggngtgtccagtgtgaggtgacgaacgtgggtggaggacgtgggcggaggtcgttggtccgaggccgtggggtccggtctcgtggacgtcgtcgtccgtgtaccgtaacccgttcggttcggggtcctccggtacacgcgaagtcgtaacgttcggttattcggtcccgttcggggtccgcgtacggccgtaccggaagggacggcgggaccggtagggtcggggtactacggttaggtttaaggtttttacggaggggtacggtaacgacgttagttaccgaagggactactccgaggtcgggtacggactacgtccgaacgtacgtacctacggtaacgttacgttacctttacgtacgaaacgacctaacgtaccttcgtaccttactaagtaactacgactacgtcgaggaccgggtacgacggaccgccggtacttagttacgttagtacgtcgtaggtgtttaaggtcggtaggtcgttagccgggtgtacgtaggacgttaagcgtacggtacgggtaccggaaccggg

SEQ ID NO: 45053 - DNA, 763 bp, Homo sapiens
  misc_feature: GYAE6OF02HVVXN.19.67.G01.1.454.CMB.1.raw
  modified_base (533)..(533): a, c, t, g, unknown or other
  misc_feature (533)..(533): n is a, c, g, or t
  modified_base (557)..(557): a, c, t, g, unknown or other
  misc_feature (557)..(557): n is a, c, g, or t
  modified_base (584)..(584): a, c, t, g, unknown or other
  misc_feature (584)..(584): n is a, c, g, or t
  modified_base (620)..(620): a, c, t, g, unknown or other
  misc_feature (620)..(620): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctcgttggttcctggcggggactagtcgtgatcgaccctacgtaccagactcacgtggctgtgtctcgtgggcgaggaccggcaacaactaccaatcgcgacggtaccacgaccaagtaacttacgttttccaccctaccgtaaccaaaagaaaacctaaaaacctttcttacggacctacggtaaccaacaacgacgaaccgacggaacgacgtaccttaaccgtaacgttcgacctttacgtaacttttaccggtcggtacctttaccggtaaccgcggtaaccgttaaccggtttccgggggttacccctacgggtaccgtaacgggttccggactacggggtcggtacggtcggaacgtacgtactttaccgaccgttactaccgacctaatccgacgacgccncggtgacgtacggctaaggaaacngtggtacgttattaaggttttacttancgtactaagtactttaagtttactttttaccgtacncccgttttacggtacggttaccgttacgggaacccggaaacgggttaccgggaaggttacggtaaaccgtagtaaacgggtaacgttaaccggttggtacggacccgttgaacccgtcgtaacctttcggtacttcgttaccg

SEQ ID NO: 45054 - DNA, 738 bp, Homo sapiens
  misc_feature: GYAE6OF02F3YD2.19.67.G01.1.454.CMB.1.raw
tcagtactctcgtgcacgaccggtgctcgatttagagtatacatattggggtttgggggggagaggagcccagcactgggattccgaggtgtttccattcggtgctcagcactgaacacagaggactcaccatgggagttttggctgaccttgggttttcctgctgctaatttcgaggaggtcgtcagtgtgaggtgacaacgtgggtaggagacgtgggcggaggtcttggtccacgccgtggggccgtctctggagtactcggtcctgtcaacccgtcgtcgggtctcgtcagcgagcgactgtagttcgtccgtggtccgcgcggcgtaccggagggaggacggcgggaggtgggtacgcgttaggtttacgttttaggtacgggtcggacgtacgtagttacgtacggaacgtactaccgtagtacgggacgggtacgtacgttaccgacctacgttaccgaccggtaacgtacgtttacttttaccgtacgtaactaaaccgtaaccttaccgttacgttaccttacttaacgttaaacgtaccgaacgtaccgtacgtacgggacgggtacccggaacgggtaccggtaccggttaccgttcgtttaactttaacgttggttaacggttaggtacgtttaggtttaacggtcgggtacggttagttcgggtacggttacgggtaggtacgtacgtaaccgtccggtacggtaccggggacccggtaaccggg

SEQ ID NO: 45055 - DNA, 885 bp, Homo sapiens
  misc_feature: GYAE6OF02HMCBJ.19.67.G01.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcgggacatcgtgatcgacccagtacccagactcacgtggctgtgtctcgngggcgacggacggccaacaatcaacgtgcacggtacacgccaagtaacttacttttccncccaaccctaccaaaacgaaaacctaaaaacgtttcttacgtcctacggtaacccaaacgacgaacgaccgaaggaacaccgacccttacgtaaagtttcgacctttactacgtttttacggtcgggttacctttaccggtaccggtaccgtacggtaaacggttttcccgggggtccccttaggaaccccggtaccgggttcccgggggacgtacggtccggggttaccgtaggggaacctaggttaacctttccgaccgttaccctaccgaaccctacgtaccgacggtccctaaacgggcccttaacggaccggtaacggttacccgtaaggtaaacggtacgttacgggtacggggtttactttaaacggtttttacgttaaacccgttcggtaaccggttaaactttaaccgtttaaaatttttttccgttttttaaaccttttcccggtttaccccgtttaccgggttcgggttaccccggtttaacccggggtaaacccgggtaaccgggtacccgggttaagggggtaacccgtttaaacggtaacctaaccggggtaaaacgtaccggtttaggtacccggtcgtaacccggttaacccttacccgtacgttttccgttaccgg

SEQ ID NO: 45056 - DNA, 738 bp, Homo sapiens
  misc_feature: GYAE6OF02G7WO1.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccgttgggttttccttgctgcaatttcgaggaggtgtccagtgtgaggtgcaacgtggtggagacgtggcggaggtcgttggtccagccgtgggcgtctcgtgagactgtcctgtacgacccgtcgtcgggtctccgtcgagcgagcgtacgtgttagttcgtccgtcgggtcccgccgtaggccgttaccggaaggggaacggacgggccggaggttcgggtcgacgttaggtttagtttttaggtagggtacgggaaccgtactacgtttacggtaacggtacgtaccgtccgtaaggtgggacggggtacccgtaagttacccgaaccgtacttccgtaccgtaaggtacgtttaccgttttacgtactaaccggtaaacctaccgtacgttaccgttccttacttaacgaaacgttacgaacgacgtccgaacgggcgggaccgacggtaccgtaccgggtccgttacgttacgtttaggttacgttggttacgtacggttacggtttagacgggtcgtaggttacggtcgttagggtacggtacgtacggtacgttacggtccgggtacgggacccggtaacccggg

SEQ ID NO: 45057 - DNA, 749 bp, Homo sapiens
  misc_feature: GYAE6OF02JHRZ9.19.67.G01.1.454.CMB.1.raw
  modified_base (682)..(682): a, c, t, g, unknown or other
  misc_feature (682)..(682): n is a, c, g, or t
tcagtactctcgtgcacgaccggtgctcgatttagagtatacatattgggtttggtgggagaggagcccagcactgggattccgaggtgtttccattcggtgctcagcactgaacacagaggactcaccatgggagttttggctgacctgggttttccttgctgctaatttcaggtaggtgtccagtgtgaggtgcaacgtggtggagacgtgggcggaggtcgttggcctaacggtccgtggggccggtccttcgtaggagtcgtcggtcctggtacgaaccctcgtggggtcctccgtcagcgagtcgtatcgtattcggccgtgggtcccgccgtaggccttccgaggggaagcgggcccgggaggtcgggtccggacgtagggtttagtttttaggtaggggtacggaccgtaactacgttccgtaacgggacgacgtaccgagttggggacggggtcctacgttaccaacccgtctaccgtcccgagggtacgttacctttttaccgacgtaacgaaacccaccgttaacttcggttacttaccgtttaacaaagttaacgacgaacgtccgtagggaccggggtacccggaacgggaacccgtccgggtacccgtttagttaactttacggttacgttggtaaggttaccggtaaggttttaggtacgggtaccgnggttaacggtcggttacgggtgggaaccttagggtaaccctggtaccggggtccgggtaacccgggg

SEQ ID NO: 45058 - DNA, 773 bp, Homo sapiens
  misc_feature: GYAE6OF02IWT7U.19.67.G01.1.454.CMB.1.raw
  modified_base (117)..(117): a, c, t, g, unknown or other
  misc_feature (117)..(117): n is a, c, g, or t
  modified_base (281)..(281): a, c, t, g, unknown or other
  misc_feature (281)..(281): n is a, c, g, or t
tcagtactctcgtgcacgaccggtgctcgatttagagtatacatattggggttgggggagctacaacaggcaggcaggggcagcaagatggtgttgcagacccaggtcttcatttcnctgttgcttctggatctcgtggttcctggcggggacatcgtgatggacccagtacccagactcactggctgtgctcgtgggcagacggccagaatcaactgactggtccagccagaactctttcaccacctacaataactaaaacttctagcctaggtaccaanagacgacaggtacaggtccctaccgttaagttcgacttactacgtttacgtagggtcctttacggtacgtcgtacgtaacggtttccggggtccctaggaacccggtacgttccgggggaactacgggtccggggtacgtacggggaacctaaggttacttttaccgaacttaccgtaccgtaaccctagtcccgtaacgaccgtacggtcccttacgggacaacgggtacgtagggaaacgtacggttagggttaccggtaactttacggttttaaccttacggttacggtacgaaacgttacgtaaaacgtttttcttttttaccggaaccttcccggttacgggtttcgggaacccggttttcccggaaacccgggtaaggggtaacccgttaagggggtttaccggtaaaaccgttccggaaacgggtaacgttaaccggttgggtccggtaaccgttaccgtaccgtacccgttagttccttaacgg

SEQ ID NO: 45059 - DNA, 841 bp, Homo sapiens
  misc_feature: GYAE6OF02GKR2N.19.67.G01.1.454.CMB.1.raw
  modified_base (282)..(282): a, c, t, g, unknown or other
  misc_feature (282)..(282): n is a, c, g, or t
tcagtactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgacgaggtcccagccaagaaccttacgttttcctaccaccctaccaaaagtaaaacctaaaaaccttnttaaccgccgtacggtaaccaaacaggaacgaccacgggaacacgacccttaccgttaacggtttcgaccttactaacgttttaaccgttggggacctaacgttacccggttaaaccccggggtaaacggtttccccggggggttaccccttacgggaacccggttaactttacggtaacgggttcgggacggtaaccgggtcccggggttacgggttacgggggaaccttaacggttaacttttaccgtaccgttacccgtaacctaacccgttaagtacccgacgtaccgaccggtccccttaggaccggttaacgggcgttaacggaagtaacggttcgtggtaccgtttaagttttattacgtttaccgtaactaaactaaacgtttattttaacgtttacttaacgtttacggtacgggttaaccgttacggaacccgggtaaacggtaacccggtaaggtttacgggaacgttaacttacccggtaaaggtaaccgttaaacggtttgggtacggtacccgttagggaccctttaaccgacggtttaacccgg

SEQ ID NO: 45060 - DNA, 679 bp, Homo sapiens
  misc_feature: GYAE6OF02GT4RE.19.67.G01.1.454.CMB.1.raw
  modified_base (207)..(207): a, c, t, g, unknown or other
  misc_feature (207)..(207): n is a, c, g, or t
tcagtactctcgtgcacgaccggtgctcgatttagagtatacatattggggtttgggggggagaggagcccagcactgggattccgaggtgtttccattcggtgctcagcactgaacacagaggactcaccatggtagttttggctgaccttgggttttccttgctgctaatttcaggagtgtcagtgtgagtgacacgtggtgganacgtggcggagtcgttggtccagccgtgggccgtctcgtagacgacttgtcctgtacacccgtgtcggtcctcgtcagcagcgtactgtgtcgccgtcggccgccgacgccgtacggaggaggcggcggtggtggtcgagtaggttatttaggagggtacggacagtacttcgtaacggagtcctacgaggtacgggacggccgttaactcccgactacttacccgacgtaacgtacgtttaccttttcctaacgaaacgtacctaaccgtacttaccttacccgttacttaaacgtaaacttacggtaacccaacgggtaccgtacggggaaccggaccggttaaaccggaccgggtacccgtaccggtttaactttaacgttacgttggtcgggtaagttcgttaagttcggtaggcgttaggtcggtaaggtcggacgtacgtgtacctagggcggtcgggacgtacgg

SEQ ID NO: 45061 - DNA, 710 bp, Homo sapiens
  misc_feature: GYAE6OF02GUQT8.19.67.G01.1.454.CMB.1.raw
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (371)..(371): a, c, t, g, unknown or other
  misc_feature (371)..(371): n is a, c, g, or t
  modified_base (642)..(642): a, c, t, g, unknown or other
  misc_feature (642)..(642): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgacaacgtggtggagacgtgggacggaggtcttgggtccaggtccgtgggtcgtctcgtggacgtactgtccgtgtaccgaaccctcgtggggtctcgtctacgcagcgactgtattgccgtggcccncgacggctcgagggagnggccggagtggtcgacgtaggttattttagtagggnggtacgtacgtagttcgtacgggtagtcgtcgtaggttacgggacgggtaccgattaccgaccgtacttccctacgaacggtaactttaccgtttttacaccgtaaagtaaaccctaacgtaccttgttacccttacgtttaacaaacggttacgaaccgtaacgtaccggttacgggaacggggtaccggaaccgggtccgaaccgggtcccggttacgtttaacggtttagttccggttagttacggaagttttacggttagtacgggngttaaggtcggggtaacgttgggtacgaagtcggtaacgtaccggcggtacgggaccgtaacccgggg

SEQ ID NO: 45062 - DNA, 846 bp, Homo sapiens
  misc_feature: GYAE6OF02GN73E.19.67.G01.1.454.CMB.1.raw
  modified_base (112)..(112): a, c, t, g, unknown or other
  misc_feature (112)..(112): n is a, c, g, or t
tcagtactctcgtgcacgaccggtgctcgatttagagtatacatattgggtttgggggagctacaacaggcaggcaggggcagcaagatggtgttgcagacccaggtacttnatttctctgttgctctggatctctggttcctggcggggacatcgtgatgacccagtacccagactcagtggctggtgtctcgtgggcgagacggccaacaagtcaactcggccaggtacccagaccaagaactattttccaccgacctaccgtaaaaggaaacctaaaaactttgttaacgacccgtaaggttaaacccaaacgtaacggacggaaccgaaggtaaccaaccggtacccgttaccgttaaaacgtttcggacctttacgtaaacgttttaccggtgggtaacccttttacgtaacccggacggttaaccggtaaacgggttccccggggttacccgtacgggttaaccgtaccgggttcccgggggagtaaccggtccgggtacggtacgggaactaggtaacgtttccacgttcctacgtaacccgtaggtaccacggaccgtaacggtcctcggtaccgtaacgggtaccgtagggtaaaacgtcgttcgggttaaagtaccggttttaagtttttaaccgtaacctttcggggtaaactaacggaaccttttaaacgttttacgtttttttaaccgaccgttttacccgtttacccgggttaggtaacccgggttttacggaacccggtaacgggtaaccgttaacggggacggttaaaactaccggtaaacgtacggtaaccgttggaacgtcggtcgttaacgaccttacgtcgttcgg

SEQ ID NO: 45063 - DNA, 616 bp, Homo sapiens
  misc_feature: GYAE6OF02FK6RL.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcgtcgtctgagacgtgtcctgtgacctctggggtctccgtcagcagcgactgtattgcctgggtcccgcctaggctccgagggaagagggccggaggtgggtcgcgtaggttactttttagagggttgggaccgtactacgttacgtacggtacgactccagtacgggagggtcccgagttccaccgtatccgtcccaagacgtacttttctcgaagaaccactactgtacctacgtttacaagtcggacacgtccgtaggacgggaccgagggacaccgggtccgttaccttagttacgttggtgtcggtagtagtttaagtgggcgtacggttggcgttgggtaggacgtagtacgtcgtacggtcgggacccgtaaccggg

SEQ ID NO: 45064 - DNA, 831 bp, Homo sapiens
  misc_feature: GYAE6OF02G6XZW.19.67.G01.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatgggtagttttggctgaccgttgggttttcccttgctgctaattcgaggngtgtccagtgtgaggtnacgtaacgtgggtagaggtacgtgggcggtaggtcttggtaccaggccgtgggtcgtctcgtgacgcttgtcctgtccgtaacccgtcggttcgggtcctaccggtcacgccacgcgtacgtgttacgtcgccggtcgggtccccgcggacggtcctaaccgggaggggaacgggcgggaccggggttacgggcgggttacccgaggtttaaccggttttagttttaagggtacggggtcggaccgttaacgttacgttaacggtaaccggtacggttaaccctacccgtaagggtaccgggggacggttcccgtaacgttcccgaacccgtcttaccgtcgtacgtaaccggttaccttttaccgtaccgtaacgtaacctacgttaccgttacgttccttaccgttaacgtaacgtaaccgtacgtaccgtccggtacgggacgggtaaccgggacgggaacccgtccggtaaccctttaccgtttaggttacggttagttacggttaacggttaggttacggtttacggttcgggtaacggttcggttaacgggttcggtaacgggtacgttaaccgggtacgtacgttacccgggtacgggtaccgggggtaaccccggtaaccccggggg

SEQ ID NO: 45065 - DNA, 655 bp, Homo sapiens
  misc_feature: GYAE6OF02GE2E3.19.67.G01.1.454.CMB.1.raw
  modified_base (177)..(177): a, c, t, g, unknown or other
  misc_feature (177)..(177): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtactctcgtgcacgaccggtgctcgatttagagtatacatattgggtttggggggagaggagcccagcactgggattccgaggtgttccattcggtgctcagcactgaacacagaggactcaccatggagttttggctgaccttgggttttccttgctgcaattcaggaggtntccagtgtgaggtgcaacgtggtggagacgtgggcggagggtctttgggtacccaggtcccgtggggccggtctcgtgagactgtccgtgtcgaaccctcgtcggggtcctcgtcgagcagcgatgtattcgcctggccncagcncgagggagcggccgaggtgggcgcgtaggtttatttagaggtcggacgactagttaccgaaggactactcgaagtggggacggcccgtagttccacctatccgtacacgtattaccttttcagaacgtaacacgtactgtacttcttaacaattacgacacgtcctagggacgggtaccggaggtaccgccgggtaccgttagttagtttagttggttggttaaggtaaggtttagttaggttacgggtaccggtaaggttcgggtcggtttagggtacggtacgttaacggtacgttaccggacgggttaccggggacccgttaacccgggg

SEQ ID NO: 45066 - DNA, 831 bp, Homo sapiens
  misc_feature: GYAE6OF02JFN8J.19.67.G01.1.454.CMB.1.raw
  modified_base (123)..(123): a, c, t, g, unknown or other
  misc_feature (123)..(123): n is a, c, g, or t
  modified_base (542)..(542): a, c, t, g, unknown or other
  misc_feature (542)..(542): n is a, c, g, or t
tcagtactctcgtgcacgaccggtgctcgatttagagtatacatattgggtttggggctgggagaggagcccagcactgggattccgaggtgtttccattcggtgctcagcactgaacacagnggactcaccagtggtagttttgctgaccttgggttttccttgctcgacgtatttcgacgggagttcgtaccgtaggttgtagggaggttcgaccgtaaacggttggggtagggcccgtaaggttcggggacgggtacggtcggtttcggccgtacggtccggtacgggggtccggttacgtccgttggaacggtaccgttcgtccgttggtaccgtaaccccgttggttcgggggtaccttcccgtcgacgtacgacggtacggtcttaggttcgtccggtccggttacgggccacggtacgtccgtaccggaaggggacggtaccggggtcgagggttcgggaccgtacggttagtttacgttttaagggagggtcggtaacaacggtttattaccggaacgggtactaccgtaacgngggtacggacggtcccgtagttaccccacgtacgtccgtaccgtacgacgtttaccgtttacctacgtaacgtaacgtaccctacgttccgttacgttcttaaaccgtaacgtacgtaactaccggtaccgtagggacccgggtacggtaccggtaccggtaccggttaccgttacgttacgttacgttagggttacggttacgtaaggttacgttaggtaaccccgggtagtaggttccgggacgttagggtacgtaccgtaaggtacggtaccgtagggtacccggg

SEQ ID NO: 45067 - DNA, 715 bp, Homo sapiens
  misc_feature: GYAE6OF02I8JGC.19.67.G01.1.454.CMB.1.raw
  modified_base (305)..(305): a, c, t, g, unknown or other
  misc_feature (305)..(305): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
  modified_base (620)..(620): a, c, t, g, unknown or other
  misc_feature (620)..(620): n is a, c, g, or t
  modified_base (656)..(656): a, c, t, g, unknown or other
  misc_feature (656)..(656): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccgttgggttttccttgctgctaatttcgaggaggtgtccagtgtggaggtgacgaacgtggtggagacgtgggcgggaggtcgtttcggccacggccgtggggcggtctctggacgtactgtccgtgtaccgacccgttcgtcggggtctccgtcgngcgagccgacgttgttacttcggcccgttgggtcccgtccgacggtcctaccggaagggggaacggcgggaccgggaggttcggggtacgtcgtaagggtttttatttttagggtaggggtacggggtaacgtaacgttacgtttaccggtaacggggaacgttaccgttaccgtagggtacggggtacggggtaccgtacgtttacccgacctacttccggtactaggtactcttttacgaacacgtacacttactcgtacttacgttaanactacgacncggtacctagggacggcgaacgacgtccggtctnttacgttgtcggttagtagtagtgttacggacggtntaaggtcggtagtacggtagactagtacccgtaggtacggtacgggtacccgtaacggg

SEQ ID NO: 45068 - DNA, 690 bp, Homo sapiens
  misc_feature: GYAE6OF02HOJ7O.19.67.G01.1.454.CMB.1.raw
tcagtactctcgtgcacgaccggtgctcgatttagagtatacatattgggtttggggggaggaggagcccagcactgggattccgaggtgttccattcggtgctcagcactgaacacagaggactcaccatggagtttggctgacctgggttttccttgctgcaatttcaggtaggtgtccagtgtggaggtcgcaacgtggtggtaacgacgtggcgggtaggtctttgggtccaggtcccggttggggccggttctccggttaggaacggtccgttggttcctggtaccgtaaaccccgtcggttcggggtccgttccggtcgacgtcgacgcgtaacgtgtagttcgtccgtcgggtccgccgaacggtccgtaccgaagggtaggacggccgggtacggttggggcgacgtagggttacttttaggtacgggttaggtaccgtacgtattaccgtaggacgtacgtcgagtagggacgggtccgtaagttcccacgtactccgtcgaacggtacttaacgtttctaccgaagtaacgactcgtagtcttactaagtacagaacacgtcgtagacgggtacgaggaccgcggacctcgtattgtgtcgtagtagtacgttgtacggtcggagtacgggtcgacggttggacgtacgtaagccggtaacggtccggccggtaaacggg

SEQ ID NO: 45069 - DNA, 811 bp, Homo sapiens
  misc_feature: GYAE6OF02IF1IX.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccgtgggttttcctgctgcaatttcgaggagtgtccagtgtggaggtgcaacgtggtggagacgtgggcggaggtcttggtccgaggtccgtggggcgttctcgtgagtactggtcctggtcgaaccgtcgtcggggtcctccgtcgagcgaggcgtactagtcgtcgccgtcgggtcccgcgacggccgtaccggaaggtaacggacggcggtacggtcgggtacgacgtaaggtttattttaggacgggtacggtaacgtacgttacgtttacgtacggaacgtacgtaccgtaggtcggggacgggtaccgtaacgttccgaaacccgtacgttcccgtaacgtaacggttaacggttttacccgttttacgtaaccgtaaacggtaaaccctaaccgttacgttacgttaccgtttagttaaaccctaaagtacgttaaaccgcggtaaccgtgggaaccgggaccgggaaccggtaacccggtaccgggttacccgttaacgtttacgtttaacggtttaggtaagtttagggtaacggttaccggtttaaggtcgggaaaccgttcggggttaccgggttacgggttacgggttaacggtaacggtacggtaaccgttaccgggaaccgggtttacgggggaacccggttaacccgggg

SEQ ID NO: 45070 - DNA, 824 bp, Homo sapiens
  misc_feature: GYAE6OF02GG4PK.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggagtttggctgaccttggttttcctgctgctaatttcgaggtagtgtccagtggtgaggtgctaacgtgggtggagacgtgggcgggaggtcgttggtccaggtcccgtggggtcggtctcgtaggacgtactcggtccttggtacgaacccgttcggttcggggtcctccggtcagccgaggaccgtattagtacgttcgccggttcgggtcccgcgtacggtccgtaccggaaggggtaacgggacggggtccgggagggtcggggtccgtaggttagggttttaacgtttttaggacggggttacggggaactacgtacgttacgggtaaccggtaacgtcccttacggtaacggttacgggggaaccggtaccgtaacgttaccgaacccgtacgttaccgtaccgtaaggttaccgtttaacctttttcgaaccgtaaacgtaaccaaccggttaccttcggtacctttaactaactaaacggtccgaaacctacggtccctaggggtaacccgggtaccggaaccgggtaccgtacccgggttcttaactttaagttggttgtacggttagtacggttaggtttacggtacgggtacggttaacggttccgggtagttacgggtaaccggtacgttaacggtagttaccgggtaaccggggtccggggaaccccggtacccgggg

SEQ ID NO: 45071 - DNA, 774 bp, Homo sapiens
  misc_feature: GYAE6OF02F3E6V.19.67.G01.1.454.CMB.1.raw
tcagtactctcgtgcacgaccggtgctcgatttagagtatacatattgggtttgggctgggagaggagcccagcactgggattccgaggtgtttccattcggtgctcagcactgaacacagaggactcaccatggtagttttggctgaccgttgggttttcctaggctgctaatttcgaggaggtgtcgagtgtggaggtgcgaacgtggtaggagacgtgggacggaggtcgttgtccgaggtccggtgggcggttctcgttaggacgtacgttgttccgtgtaccgacccttcggtcggggttcctaccgtcgacgcgaggtccgtagtgttacgttcgtccggtacggtccgccggtacggccgtacgaggggacggcggtcggaaggttcggtcgacgttagtttagtttacggaggtagggactacgtacgttcggaaggcgtactaccgtaagtggggaaccggtccgtactaccgacccgtagttacccgtaaccgaggttacgttttacctttacggaacctaaggtaacccgtacctacgtttcgtaaccgtttaactaaactaagaccggaaacctacgggtcccgggtaacggaccggggaacccgtaagggtccccgttaccgggaccttttacggtttaggtttacgttaggtaggttacggaacgggtttaggttttccgggaaggggttaacctgtttacggggtcgttaaccggggtaggacccgttaaggccgtttaaccggacggggttcccgggg

SEQ ID NO: 45072 - DNA, 718 bp, Homo sapiens
  misc_feature: GYAE6OF02IC7AS.19.67.G01.1.454.CMB.1.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagttttggctgaccttgggttttccttgctgcaatttcaggaggtgtccagtgtgaggtgcaactggtggagactggcggaggcttgggtccagcctggggcgtctctgagacctggtcctgtgaaccctntcggggtctccgtnagcagcgtactgtattgcctggtcccgcaggctccgagggagaggccggaggtgggtcgctaggtattttagtaggtcggggacgacgtatttcaacggagtacgtccagttacggggaagggtcccgaagtttccgaaccgtattccgtcccgaagtacggtacctttttactcctaaggtaaaccctacaaccgttgtacctttaccgtttcctaaaaagttcgaaacgtagacccgtagggtaaccggggaccggaacgggaaacccgtacggggtcccggttaactttaacgtttaacgtttacggttacgttagggtaacgtttacgggttttaacggttacgggtacgggtaacgttggggtacccgtttaggggttacggaactaggttaaccgttaccggacgggttaccgggggcccgtaaacccggggg

SEQ ID NO: 45073 - DNA, 768 bp, Homo sapiens
  misc_feature: GYAE6OF02IOFC6.19.67.G01.1.454.CMB.1.raw
  modified_base (195)..(195): a, c, t, g, unknown or other
  misc_feature (195)..(195): n is a, c, g, or t
  modified_base (705)..(705): a, c, t, g, unknown or other
  misc_feature (705)..(705): n is a, c, g, or t
tcagtactctcgtgcacgaccggtgctcgatttagagtatacatattgggtttggggggggagaggagcccagcactgggattccgaggtgtttccattcggtgctcagcactgaacacagaggactcaccatggtagttttggctgaccgttgggttttccttgctgctaatttcgaggtagtgtccagtgtgnggtgcaacgtggtggagacgtggcggagtcgttggaccagccgtgggccgtctgtggagtaccgtcgtccgttcgtaccgaaccccttcggttcgggggtccttcccggtaccgagctacggcgtacttggtacttcggtcccggttcgggtaccccgccgacggtacccggtaccgggaaggggaaaccggtacggggacccgggttaagggtccggggttaccgacggtttaaacgggttttaagtttttacgggtaaggggtacggggtaaccctaacgttacgttttccggtaaacggtacgtacccttcggaagttcggggaacgggtcctaacgttcccgaacccttaacgttcccgtacgtaacgtacgttaaccttttcgactacgaactacgtacgtcgttacccttacttacaaagtacgaacccgtacgccgtggaacggggaccgacggaccgtccgtacgttacttacgtttagtgttaagtgttaggtactttggnggtcgttacggtggtcgttcgggtacgtaggacgttacgtacacgggtcgacccggtaaccgg

SEQ ID NO: 45074 - DNA, 720 bp, Homo sapiens
  misc_feature: GYAE6OF02HBF0J.19.67.G01.1.454.CMB.1.raw
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (695)..(695): a, c, t, g, unknown or other
  misc_feature (695)..(695): n is a, c, g, or t
  modified_base (708)..(708): a, c, t, g, unknown or other
  misc_feature (708)..(708): n is a, c, g, or t
tcagtactctcgtgcacgaccggtgctcgatttagagtatacatattgggtttgggacaacaggcaggcaggggcagcaagatggtgttgcagacccaggtcttcatttctctgttgctctggatctctggttcctggcggggacatcggtgatcgacccagtacccagactcacgtggctgtgtctgtcgggcgacgaccgccacaacgtcaacgtgccgaggtcccagaccagtaacttactttttccaccctacccgtaaccaaaacgtaaaacctaaaaattttccgttaacgccttaaggtaacccaaacgaggtaacgaccgaacggacaccgtacccttaccgttaaacgtgccttacgtactttacggtcggtacctttccgaccggtcgccggttaacgtttcccggggtaccctacgggtaccgacggttccgggcaggtcgggtcgtagggactacgtntttaccacgttccactacncgtacgagtacnccgtccgtacgacgtaggtccgaagacggtaagttcggaccgttaagtttccgtttaattcgtaccggttactaccgttattactttttaccgtttttacttcggttacccgtacggttcggttaaccggtccgggaaacccgaggggttaaccgagggtaccggtaataccggtaagaccgtaagtcggtcgntacggcattccgngttcttacgtac

SEQ ID NO: 45075 - DNA, 798 bp, Homo sapiens
  misc_feature: GYAE6OF02GB6AZ.19.67.G01.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
tcagtactctcgtgcacgaccggtgctcgatttagagtatacatattgggggtttggggagaggagcccagcactgggattccgaggtgtttccattcggtgctcagcactgaacacagaggactcaccatggtagttttggctgaccgttgggttttcctgctgcatttcaggngtnccagtgtgaggtcgacacgtgggtggagtactggcgggagtcgttaggtccaggtcccgtggggccgttctgtgacgtacttgtccttggtaccgaaccccgttgtcgggggtcctccggtacacggcacgcgacttagtatttcggaccgttcgggtacccgccgtacgtccgtaccggaggggaaacggcgggacccgggtaggtcggggtcgacggttaagggttttactttttaggtaggggtacgggtacgaacttacgtttacggtaacggagtaaccgtacgtaacgtacggggtaacggggtacccgtacgtttacccgaacctttacgtacccgtacgtaacgggtaaccttttaccgtttttacgtaacctaaacggaacctaaccgttaaccggttcgtttacccgttactttaaacctaaagttaccgtaaaccgtacggtacccgtaggggtaaccgggacccggtaagggacccgtacccggggttccttaaccgtttattacgttggtacgttaggaggtttacgttgtcgggtacgtagttccgggtacgttacgggtaccgaggtaaccgtgtacgggacgggtaccggggtcgtaacccggg

SEQ ID NO: 45076 - DNA, 731 bp, Homo sapiens
  misc_feature: GYAE6OF02H54ES.19.67.G01.1.454.CMB.1.raw
  modified_base (182)..(182): a, c, t, g, unknown or other
  misc_feature (182)..(182): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggttttcctgctgctaattcgaggtaggtnccagtgtgaggtcacaagtgggtaggagactgggcgggagtcttcggacacggccggtgggccgtctcgtgacgtacttcgtacctggtaccgtaaccgtcggtcgggggttcctccggtacgacggtcaggtccgtacttaggttacttcggccgtcgggttcccgccgacggtccgtaccggaagggacggccggaccgggtaggttcgggtccgaggttacggttttattttaacggacgggtcggtaacgacgttaacgtacgttacggaacgttacaccgtaggtcgggtacggtaccctattccgactacgtccgtacgacgtacgttacttttcgacgtaacgaactacgtacgttcgtcttaacctaacgtaagtacgaactacggtccgagggaccggaccggtaacggacccgtacggtacccgttagttaacgtttggtcgtagttacgtagttacggtttaagcggtacgtaacggttggtacggtacggtacggtagtacggtacgtaccggtacggtcgggaaccggtaaccggg

SEQ ID NO: 45077 - DNA, 995 bp, Homo sapiens
  misc_feature: GYAE6OF02IJB85.19.67.G01.1.454.CMB.1.raw
tcagtactctcgtgcacgaccggtgctcgatttagagtatacatattgggggtttggggagaggagcccagcactgggattccgaggtgtttccattcggtgctcagcactgaacacagaggactcaccatggagttttggctgaccttgggttttccttgctgctaatttcgaggaggtcgtccagtgtgaggtgactaacgtgggtggacgtacgtgggcggaggtcgttcggtccaggccggtggggcgttctcgtggagtacgtcgtccgtcgtacgtaacccgtggttcgggggtccttcccggtactacggacgtcgcggtacttgtattcggtccgttacgggtccccgaccgacgggtcctaccgggaaggggaacggtaccggggccgggtagggttcggggtacccggtacggttaaacgggtttttaagttttttaaggtacggggggttacggggtaaacccgttaacgtaacgttttaacccgggtaacggggtaacgtaacccgttaccggtaaacgggttacgggggggaaccgggttacccgttaacggtttaccccggaaaccctttacggtacccgttacccggttaaaacgggtacctttttaccgttttttaccgaaccggtaaaccgttaaaaccacccgttaaccgtttaccggttacctttaaccgtttaaaccgtaaagttaacccgggtaaacctaccggtacccggtttacggggaacccggggaccccgggtaaaggggtacccccggttaaccggggtacccgttttaaccggttttaacgtttacggtttacggggttaacgtagggttaaccgggttttaaggtttaccggggtaagggtacccgggtttaaggttccgggttaacccgggttaccggggttaagggaacccgtaacggttaaccggggttaacccgggtaaccccggggttccgggggtaacccgggttaaaccccccgggggg

SEQ ID NO: 45078 - DNA, 842 bp, Homo sapiens
  misc_feature: GYAE6OF02GZAFO.19.67.G01.1.454.CMB.1.raw
  modified_base (113)..(113): a, c, t, g, unknown or other
  misc_feature (113)..(113): n is a, c, g, or t
  modified_base (118)..(118): a, c, t, g, unknown or other
  misc_feature (118)..(118): n is a, c, g, or t
  modified_base (132)..(132): a, c, t, g, unknown or other
  misc_feature (132)..(132): n is a, c, g, or t
  modified_base (573)..(573): a, c, t, g, unknown or other
  misc_feature (573)..(573): n is a, c, g, or t
tcagtactctcgtgcacgaccggtgctcgatttagagtatacatagttgggggtttggggagaggagcccagcacgtgggattccgaggtgtttccattcggtgctcagcacngaacncagaggactcaccngtggtagtttggctgtaccgttcgggttttcctggctgactaatttcgagggtaggtcgtccaggttggtcggacggtgaccgtaaacggttcgggtaggaacggtacggtcggggacgggtacgggtcgttacgggtcccaacggtccgggtcggggtcggttctcggtaagaacgtcgttaccgttccgtggtaaccctaccgttcgttcgggggtccctccggtacgaagtccgacggcgtacgttgttaacgtcggtaccggtccggggtccccacggtacggtcccggtaacgggtaacggggaaacggaccgggggtcgggacgggttacggggtcgtacggttaaagggttttacgttttaaggtacggggtaccggtaagtaccgtaagttaccggtacgatacccgtctaaggtcgggaacggtacccggtnttacccggaacccgtttactcccgttaacggacgggttactttaaccgttttaccgacgtaaccgtaaactaccgtcgttaccgtactttaccttaacgtaaactacggaaactaccggtcggaacggtcccgggaacggtaccggaaacggtcccggttagtacgttaacttaggtacgtggttaagtcgttaacggttgtacgggtcgtaggttcgtaggtacggtaacgcggtacgtacggcgggtaggccccggtaggtacccgg

SEQ ID NO: 45079 - DNA, 854 bp, Homo sapiens
  misc_feature: GYAE6OF02FIF35.19.67.G01.1.454.CMB.1.raw
tcagtactctcgtgcacgaccggtgctcgatttagagtatacatattgggtttgggggggagaggagcccagcactgggattccgaggtgtttccattcggtgctcagcactgaacacagaggactcaccatggtagttttggctgaccttgggtttttccttgctgctaatttcaggtaggtgtccagtgtgaggtcgagaacgtggtaggagacgtggcggaggtcgttggccagccgtgggcgtctcgtgagtactcgtccgtgtacgaaccctcgtggggtcctccgtcacgtcgagtcgacgttgtagttcgccgttcgggtacccgccgtaacgtccgtccgtaacgggggaaacggacgggtacccggggacgggttacgggggtccgtaccgggttaagggttttaagtttttttaacgggttacggggttacgggggttaccggtaacacgttttaccggtaaaccggggttaccgtaaccgtacccggaacggtttagggaccgggggtacccggttaacggtttacccgtaaccgaaccgtttccgtacccgtacggtaaccgtttacccgtttttacctaccgtaaacggtaaacctaacccgttacgttaccgttaccgtttaaccgtttaactaaacgttaacggaaacccgtaccgtaccgttaacggacgggtaccgggaacgtaaccggaccgggttaccgttagtttaacgttaagttggttaggttaagtggttaacgtttaggttacgggtaacggttacgttacgggtaggtttcgggtacggaacgttacggaccgttcggtacgggttacggggttacccggtaacccggg

SEQ ID NO: 45080 - DNA, 956 bp, Homo sapiens
  misc_feature: GYAE6OF02JO0RU.19.67.G01.1.454.CMB.1.raw
  modified_base (906)..(906): a, c, t, g, unknown or other
  misc_feature (906)..(906): n is a, c, g, or t
tcagtactctcgtgcacgaccggtgctcgatttagagtatacatattggggtttggggagaggagcccagcactgggattccgaggtgtttccattcggtgctcagcactgaacacagaggactcaccatgggagttttggctcgaccttgggtttttccttgctgcaatttcgaggaggtgtcctagtgtgaggtgcaacgtggtggagacgttgggcggtaggtcgttggtccaggtccggtgggccggttctcgtcggagtaccgttgtccgtcggtaccgtaacccgtccggttcggggtccgttcccggtacgacggtctacggtccgtacgttaggttactttccggcccggttcggggtccccgaccggtacggtcgttacccggaaacgggggtaacggaaccgggggtcccgggtaacggggttcggggtacgtacggtaacgggttttaaacggtttttaaggtaacggggttacggggaaaccgtaacgttaacctttcgggtaacccgggtaagtaacccgtacgtaggtacggggaccgggtacccgtaactttaccgacctaactttaccgtaaccgtaaccgggtttaacgtttaccgtttttaccccgtaaccggtaaagtaaaaccccgtttaaccgtaaacgtttccggttccccttaacgttttaaaaccgaaacgttaaccgaaaccgtaccggtaacgttacggggaaacccggtaccggggaaaacgtaccccggtacccgggttaacccggtttaactttttaaaccgggttaggtttaccggttacggttaacgtcggggttttaaacgtttcgtaacgggggtaacgggtttacgtacggggttacccggttaagggttaccgggtaaccgtttaacgggngtttaaccccggtacggggggtaccccgggtttaagggaaacccccgggg

SEQ ID NO: 45081 - DNA, 833 bp, Homo sapiens
  misc_feature: GYAE6OF02HW3OU.19.67.G01.1.454.CMB.1.raw
  modified_base (642)..(642): a, c, t, g, unknown or other
  misc_feature (642)..(642): n is a, c, g, or t
  modified_base (652)..(652): a, c, t, g, unknown or other
  misc_feature (652)..(652): n is a, c, g, or t
  modified_base (666)..(666): a, c, t, g, unknown or other
  misc_feature (666)..(666): n is a, c, g, or t
tcagtactctcgtgcacgaccggtgctcgatttagagtatacatattggggtttggggggagctacaacaggcaggcaggggcagcaagatggtgttgcagacccaggtcttctatttctgtcgttgctctggacttctcgttcgggttcctggcgggggtaactagttcggtgacgtcggtaacccacgttacccacgtacctcgacgttcgggctggttcggttcctcggtacggggccgggaacggaccgggaccctaaacgaaacttaccgaacgtggaccggtaacgggtcccaacggaccctaaagtaacctttaaccttttccgacccctaaccgtaaaccgaaaagtaaaacccttaaaaacgtttccgttaccggaccgttaacgtaaacccgaaacgacggaaacgtaccgaacggtaacgtacgtaccctacgttaaggttcgtacttacgtaactttccggtacggtccttacggtacgaccggtacggtaaccggttccggggttcccacggtaaccggttcggtaccggggacgtacggtcggggtactcggggtaactacggtttcttaccgacttaccgtaaccgtacgttacgacgacgtccgacttcccgaggcgacggtaacngtaaacggtntaccggtacggttnttaagtttccgtatcggtaaccaagttaacttaacgttttcgtttacctgttccggccgtttacgggacgttcggtaacgggaacggtaccgggttaagaaccggtagtacgtaacggttaacgaccggttgaccgttaccggcaccgtaccttagtcccgttaacg

SEQ ID NO: 45082 - DNA, 843 bp, Homo sapiens
  misc_feature: GYAE6OF02JCONS.19.67.G01.1.454.CMB.1.raw
  modified_base (130)..(130): a, c, t, g, unknown or other
  misc_feature (130)..(130): n is a, c, g, or t
  modified_base (650)..(650): a, c, t, g, unknown or other
  misc_feature (650)..(650): n is a, c, g, or t
tcagtactctcgtgcacgaccggtgctcgatttagagtatacatatttggggtttggggagaggagcccagcactgggattccgaggttgtttccattcggtgctcagcactgaacacagagactcaccntggtagtttgctgaccttggttttctgctgctaatttcgaggtaggtctccgtagtgtggaggttgacctaattgggtacggagacgtgggtaccggacgttccgtttcgggaccctaggcccggttgggggtcccgttcgttcgtagtaaccggtaccttgttccgtacgttacggtaccccgttggttcggggtccttacccgtacgacggtcgacgtaccggtctagttacgttccggtccgttccggggtccgtaccgacggttctaccggaagggaaccgaaccgggtccgggtaggtttcgggactaggtttaccggtttagtttttaggtacgggtcggggtaaactaccggtttacctttacgggtaaggaacggtacccgtagtaggaacgggtacggggtccccttaaacttccggaaccctacgttcctaaccgacgttaaccctttaacttttccgtacgaacgtaaacctactaacgttccttacttacttaacgtagtaacgtaanaggtacccgtagggaccgggacggaaccggtacccgtaaccgggaccgttaccgttaaagtttccgtttaggttacgttccggtaagggtttacgttagggtacggttcggtagtttacggtccgggtttacggaacggttaacggtaacgtaccgtacggtacccggggttaacgacccgggttaacccggg

SEQ ID NO: 45083 - DNA, 881 bp, Homo sapiens
  misc_feature: GYAE6OF02FPE1Q.19.67.G01.1.454.CMB.1.raw
  modified_base (172)..(172): a, c, t, g, unknown or other
  misc_feature (172)..(172): n is a, c, g, or t
tcagtactctcgtgcacgaccggtgctcgatttagagtatacatattgggtttgggggggagaggagcccagcactgggattccgaggtgtttccattcggtgctcagcactgaacacagaggactcaccatggagtttggctgacctgggttttcctgctgcaattcaggngtgcagtgtgaggtgcaactggtggagacgtgggcggaaggtcttggtcccgagtcccgtggggacggttctcgtggaacgtacttcgtccgtaggtaccgtaacccgttcgtacgggggttccgttccgtccgacggtccgtacggtccgtaacgttaggttaacgttccggtacccgttcgggttaccccgggtacccgtacggtaccggttcccggaaacgggggtaacggtaacggggaccgggtaacggggttcggggtaccggtacggtaacgggttttaacttttttaacgggtagggttaccggggtacggtaacgttaacggtttaccgttaacgggacgtaaccgttacccgtacggttacggggaacggggtaccgttacggtttaccaccgtactccgttacccgaacggtaacgtttaccttttcgtaccgttaaacggtaacctaacgttacgttaccgtaccgtttacttaacgtaaacgttacgaaaccgtacgtacccggtacgggaccgggaccggtaacgggtacccgtacgggtacccggttacgttaacgttttaacggtcgttaggtacgggttacgtttaagggtttacggtacgggtaccggttaggttccgggttcggttacggggacggtttaacgacggttaacccgtacggtacgggttaccgggtaccgtaaccccgggg

SEQ ID NO: 45084 - DNA, 546 bp, Homo sapiens
  misc_feature: GYAE6OF01EW0MF.44.26.C04.1.454.CMB.1.raw
  modified_base (349)..(349): a, c, t, g, unknown or other
  misc_feature (349)..(349): n is a, c, g, or t
  modified_base (537)..(537): a, c, t, g, unknown or other
  misc_feature (537)..(537): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccagataccaccggggaaattgtgttgacacaatctccagccaccctgtctttgtctccaggggaaagagccaccctctcctgcagggccagtcagagtgttaggaactacttagcctggtatcaacagacacctgccaggctcccaggctctcatctatgatgcatccaatacgggccgcgggcatcccagccaggttcagtcggcagtggttcngggacacatttcactctcaccatcagcacgcctgcacgccctggagatttcgcgtacttattactgaccaataacttatttacttttttacaccgttaacttagttttcggaccgtaacggggtaccaagtacgtggagtatacgaaaggacgttagtggtctgaccacctacttcttagttcccttntcttccccg

SEQ ID NO: 45085 - DNA, 569 bp, Homo sapiens
  misc_feature: GYAE6OF01EVKTY.44.26.C04.1.454.CMB.1.raw
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccaggggaaagcccctaaactcctgatctataaggcatctagtttggaagtgggtccatcaaggttcagcggcagtggatcgtgggacagaattcgctctcaccatcagcagcctgcagcctgatgtattttgctaactttattactgacctaacaattaattaaatttaggtttttcggtagggttaccggttcggaccgtaaaggggtacgttaagggtaggaaacgttaccgaaaacggtaacgttcggtagggcctgacctaacctagttcctagttacctttcacttcccgttaccccg

SEQ ID NO: 45086 - DNA, 546 bp, Homo sapiens
  misc_feature: GYAE6OF01CW24Q.44.26.C04.1.454.CMB.1.raw
  modified_base (275)..(275): a, c, t, g, unknown or other
  misc_feature (275)..(275): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtatagtagttggttggcctggtatcagcaagaaaccagggaaancccctgaactcctgatctctgctgcctcactctgcaaggtgagtctcttcaaggttcagtggcagtgatcgtgggacagatttcacttctcaccatctccagtctagctaaacctgaacattttgacctaactttactactgtacaacgagtaattaacttactcgtccccgtttactaccgttttgggtaccggggtacctaaggcgttaggaacgtacgtacaaaacggtaacttggtacggcgtacgaccgacctactcgtcgttacc

SEQ ID NO: 45087 - DNA, 702 bp, Homo sapiens
  misc_feature: GYAE6OF01B0PLP.44.26.C04.1.454.CMB.1.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggttcgagatgtgacatcgagatgaccaagtctccttccttcctgtcttcttctgttggaggcagcgtcaccatcacttggccgggngagtcagggttcgttttcggngctgttgcctggttacaaacggaaaagggggnacggcccctaaggtcctcgtctctcggtagaaaccaggtactagggaaggtagacggtccccgtcgaaggttccagttcgcctaggtccgagggtcgggtggggacccggtagtcccagtcctaccacctagttacgcgtaccgtggccggtcctaggaacgtactttcgtacgtaaccttaactttacttttcgtaggtccaaggtcctaagttactacaacgtttacggtccgtccccgtttacttacggttttaccgggacccggtaaggggaaccctaggtaccgtaacgggtaaacttaaccggaaaacgtacgttacgggtcggtaccttacggacctaaccggtcttacccgttcggttaccctttacccaaccgtttcccgttacccccggacttaagttccctagttaactttaaac

SEQ ID NO: 45088 - DNA, 621 bp, Homo sapiens
  misc_feature: GYAE6OF01D4F9S.44.26.C04.1.454.CMB.1.raw
  modified_base (239)..(239): a, c, t, g, unknown or other
  misc_feature (239)..(239): n is a, c, g, or t
  modified_base (279)..(279): a, c, t, g, unknown or other
  misc_feature (279)..(279): n is a, c, g, or t
  modified_base (606)..(606): a, c, t, g, unknown or other
  misc_feature (606)..(606): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggttcgagatgtgacatcgagatgaccagtctcctccttctgtcttcttctgttggaggcagcgtcaccatcacttgccgggcgagtcaggttcgttttcggngcttgttcgccttaggtttcaaaacgaaaaaggggggtanacggacccctaaggtcctcggtctcgtcgtagaaacccagactaggaaggtagacgtcccgtccgtaggttcagtcgccgtagtccgagggttcgggtacggggccggagtcccactcctccaacctagttacgccgaccgtggccggtcctaggaaagtcttctgacttaacttatttctgtcagctagtatcgtacgttagtccgtacccgttcgtacgttttcggccgtaacgggacctaaggtcgtaagtaaagtacaaacggtactggtcggtactgacccactacgttctcgttccttacgacctttccgttcccgacctntacctgtacttaacg

SEQ ID NO: 45089 - DNA, 606 bp, Homo sapiens
  misc_feature: GYAE6OF01BMRY4.44.26.C04.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (446)..(446): a, c, t, g, unknown or other
  misc_feature (446)..(446): n is a, c, g, or t
  modified_base (569)..(569): a, c, t, g, unknown or other
  misc_feature (569)..(569): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagagtattagtagttggtggcctggtatcagcaagaaaccgagggaaacncccctaaactcctagatctaagtaaggcattcgtaaggtttagggaagtcgggtaccagtacgtaaggttcaggcggctaggtggatcgagggacagtaatcactctacacatacagcagtccctgccacgtcctagacttgttacttttgaacttaaactttataccgtnaacccgtaataagttaacgtaaagttagtttaacttcgttacgtacgggtttaggtttcggacccggtaaggggtaaccaaggtacgtacgggtaataacgtaacgaaaacggtcgttacggnggtacctaggtaccctaaccgtattcgttcgttaccc

SEQ ID NO: 45090 - DNA, 817 bp, Homo sapiens
  misc_feature: GYAE6OF01BBEHB.44.26.C04.1.454.CMB.1.raw
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
  modified_base (399)..(399): a, c, t, g, unknown or other
  misc_feature (399)..(399): n is a, c, g, or t
tcagacagtatatacacgaccggtgctcgatttagtctagcgactttgggtttggggggtagtcgagacccagtcagggacacctagccagtggaccaagtcgtacgggtcccccgtcgtcagcctccgtgggggcctcctgcctggccgtccctggaccttccccgaagggttggcctaaagtggtcgtacgttacttcggagacttacgtacccgaggttccttcccttcctttccgtgttctttcttctaggttgggaggctagccggtacacctntcgaccttggcccgggngagtccacgggttcgttttcggngtcttggttcgccttggttacaacgtaaaagggggngacggtccccttaaggttcctacgttcttcgtcgtagaaaccgnggtacggtacggtaacggtacgacggttccccggtaccggtagggtttccaagggtcgtacccggtaggtaccccgaagggttacgggtacggggaccggtaacgttccgaacgttactaccaccgttagttacggccgtacctcgggacggtaccctaggaacttcttaccgtacgtaccttaaccgtttaacgtttaccgtacggtaaccgacggtaccaacggttactacgttaacgttacgttcccggttacccccgtttagttaaccgttttccgggaccgtaaccggggaacctaaggaccgttacggaaaccgtaacgaaacggtacggttcggtacggaccttacggacctacgtacgttcgtacgttcttaccctcttacccgttcccggacttacgttctgtattacg

SEQ ID NO: 45091 - DNA, 271 bp, Homo sapiens
  misc_feature: GYAE6OF01AVNGW.44.26.C04.1.454.CMB.1.raw
  modified_base (254)..(271): a, c, t, g, unknown or other
  misc_feature (254)..(271): n is a, c, g, or t
tcagacagtatatacacgaccggtgctcgatttagtctagcgactttgggtttgggacagaattcgctctcaccatcagcagcctagagcctgaagattttgcagtttatgactgtcagcagcgtagcaactggccgatcaccttcggccaagggacacgactggagattaaacgaactgtggctgcaccatctgtcttcatctcccgcatctgatatatacgtgtctgagcggcgtggcaaaggcgtcatagnnnnnnnnnnnnnnnnnn

SEQ ID NO: 45092 - DNA, 695 bp, Homo sapiens
  misc_feature: GYAE6OF01D6H70.44.26.C04.1.454.CMB.1.raw
  modified_base (246)..(246): a, c, t, g, unknown or other
  misc_feature (246)..(246): n is a, c, g, or t
tcagacagtatatacacgaccggtgctcgatttagtctagcgactttgggtttgggggagtcagacccagtcaggacacagcatggacatgagggtccccgctcagctccgtggggctcctgctgctctggctcccaggtgccaaatgtgacatcgagatcgacccagtctccttccttctgtcttctctgttggagcagcgtcacatccacttcggccgggcgtagtcgtaggttcgttttcggngtcgtgttcgccgttaggttaccaaaacggtaaaaaggggggcacggtacccctaaggtcctcgtctctacgacgaaaccgagacgtagggaaggtacgacggttccccgtacgaggttcagtcgtaccagtccgagggtcggcgggccggagtcccacttcacaaccgtagttacgaccgaccgtggaccggtactaggaaagtacttcgtagtaccgtaacttttatttaccgtgtacgaacggtcgtaaagttactaccgtaagttaccggtccgtacccccgtttcttaaccggttttccgggaccggtaacggggtaaccaacggtaccgttaaggaaaccgttaacaaacggtaactacggtggacctcgaccctaaccgtcttacgtcttaccttacctacttacccgttaccccgtacaacgtttctagtaactttaaacg

SEQ ID NO: 45093 - DNA, 645 bp, Homo sapiens
  misc_feature: GYAE6OF01CI7GC.44.26.C04.1.454.CMB.1.raw
  modified_base (609)..(609): a, c, t, g, unknown or other
  misc_feature (609)..(609): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggttcgagatgtgacatcgagatgacccagtctccgtcctcactgtctgcgtctagttggggacagagtcaccatcacttggccgggcgagtgccgactattaggtacttttttggccttggtttcagcaggcgctggacaaacgtcccctaagtcccctgacttccgttttctaggtactccgtaacgtttgaaagtaggtcggacgtcccgagccgtaggttcgacgccggctaggtcggtttcgtacgggaacctacgtatttccacttccgtaccaacctagtccaagccgacgccctgaccgacgtccgtaggtaggtactttaccggacgttaacctttaacgttacctacgtaacctaacgtaactttacttttaccttttttacgtaccgttacgttacgttttacggaccgtacgggaaccgtacgcggtaggagtagtaacgtaaacggacgttcggaggtcncgacactatcttcgttccttactcttcccgttcccg

SEQ ID NO: 45094 - DNA, 686 bp, Homo sapiens
  misc_feature: GYAE6OF01BNNLT.44.26.C04.1.454.CMB.1.raw
tcagacagtatatacacgaccggtgctcgatttagtctagcgactttgggtttgggggagtcagacccagtcaggacacagcatggacatgagggtccccgctcagctccgtggggctcctgctgctctggctccgaggtgccagatgtgacatccagatcgacccagtcctcccttccctcctgtctgcgtctagttcggggacagagtcaccatcacgttcggccgggcgagtcgccgactagtttacggttactttttcggcctttggttcagcgaggacgccgtacggaccaaccgcccctaacgtcctagtactttccgtttgtcggtacttccgtacgtttagaagtaggtcgtaccgtccgacgtaccgcggttacgacggtcggcgtaggtcgttacgcggtactacgtacttcaccgtctacacctataccgacgtcacggtcctacggacgtccgtacgggttacggtacttcgttaccgtaccgtactttacgttaccgtgaaccctaagttacttttactttaccttttaaccgtccgttaacggtttacgtttccgggaaccggtccggtaaaccgtggtaccgtaagggactaacgacgtaaaggtaccgtgtacgggcctaacggtcctacgtcgtttccaccggttccttacgcccgtttcccgtacccg

SEQ ID NO: 45095 - DNA, 749 bp, Homo sapiens
  misc_feature: GYAE6OF01B86YV.44.26.C04.1.454.CMB.1.raw
  modified_base (141)..(141): a, c, t, g, unknown or other
  misc_feature (141)..(141): n is a, c, g, or t
  modified_base (535)..(535): a, c, t, g, unknown or other
  misc_feature (535)..(535): n is a, c, g, or t
  modified_base (703)..(703): a, c, t, g, unknown or other
  misc_feature (703)..(703): n is a, c, g, or t
  modified_base (717)..(717): a, c, t, g, unknown or other
  misc_feature (717)..(717): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccgaggtnccaaatgtgacatccagatcgacccagtcctcccttccaccctgtcctgcattcgtagtaggagacagtagtccacctagtcctacgttcggaccggccagtcgaagtagttatttaggttaacggtttgggttacggccgttaggttactacgaacgaccgtaaacggaaaccgaagggtaaaccctacccccgttaaactcccgttagtaacgttactaacggtaacggaccttagttaccgtttaagggtttaaggaaccgggtttacgggttacccctaaggtaccggtaaacggttcgaacggtccgggtacgtagggtcgtacgtcggtagggaacgtaacgtaacgttccgtactacctacaccgtactagaccgacgtacgttccnggtacctaggtcctaggttaactcggtttaatttacggtaaccttacgtttactaccgtactaaaccgtaattaacggttaactttagttaacgtttcggtaacgtaccgggttacgaacggtaagtacgtaacggtgtaaacgtcggaaagtacgtcgtacggtacncgtcgtaaccgttntcgttacttaccttactccgttcccgtacccg

SEQ ID NO: 45096 - DNA, 518 bp, Homo sapiens
  misc_feature: GYAE6OF02FH9M0.44.26.C04.1.454.CMB.1.raw
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccagggaaagcccctaaactcctgatctataaggcatctagtttggaaagtggggtcccatcaaggttcagcggcagtggatctgggacagaattcgctctcaccatcagcagcctgcagcctgatgattttgctaactttattactgaccaaacaattaataattagtttttcgtggtacgtttcggaccaagggtactaaggtggaagtcaaacgactggtggctgcaccatctgttcttcattcttcccg

SEQ ID NO: 45097 - DNA, 590 bp, Homo sapiens
  misc_feature: GYAE6OF02JFCVK.44.26.C04.1.454.CMB.1.raw
tcagacagtatatacacgaccggtgctcgatttagtctagcgactttgggtttgggggagtcgagacccagtcaggacacagcatggacatgagggtccccgctcagctcctgggctcctgctgctctggctcccaggtgccaaatgtgacatccagatgacccagtctccttcaccctgtctgcatctgtaggagacagagtcaccatcacttgccgggccagtcagagtattagtagttggttggcctggtatcagcagaaaccagggaaagcccctaaaactccctgatctataaggcatctagtttggaaagtggggtcccatcaaggttcagcggcagtggatctggggacaggaattcactctcaccatcagcagcctgcagcctgatgtattttgactaactttattactcgaccaaacagtaacttaaagagtttattacttcaagttagttttgggacccaagggggtaacccaaaggtccgttagggaacgtaacgtttaacgaaaaccggtaaccgttacgggttacgggtacccgttagggtacccaacccggtaactttacccgttggtttaacccg

SEQ ID NO: 45098 - DNA, 332 bp, Homo sapiens
  misc_feature: GYAE6OF02F1I6H.44.26.C04.1.454.CMB.1.raw
  modified_base (276)..(332): a, c, t, g, unknown or other
  misc_feature (276)..(332): n is a, c, g, or t
tcagacagtatatacacgaccggtgctcgatttagtctagcgactttgggtttgggacgagaattcgctctcaccatcagccagcctgcagccctgatgattttgcaactttattactgccaacaatataatagtttttcgtggacgttcggccaagggactaaggtggaagtcaaacgaactgtggctgcacctatctgtcttcatcttccccgccatcctgatatatacctgttctgagcgggtctggccaagggccgacataaggctgcatcnnnnnnnnnnnnnnnnnnnnnnnnnnnnnnnnnnnnnnnnnnnnnnnnnnnnnnnnn

SEQ ID NO: 45099 - DNA, 256 bp, Homo sapiens
  misc_feature: GYAE6OF02FQNQB.44.26.C04.1.454.CMB.1.raw
  modified_base (252)..(256): a, c, t, g, unknown or other
  misc_feature (252)..(256): n is a, c, g, or t
tcagacagtatatacacgaccggtgctcgatttagtctagcgactttgggtttgggacagaattcgctctcaccatcagcagcctagagcctgaagatttgcagtttatgactgtcagcagcgtagcaactggccgatcaccttcggccaagggacacgactggagattaaacgaactgtggctgcaccatctgtcttcatcttcccgccatctgatatatactgtctgagcgggctggcaaggcgcatagnnnnn

SEQ ID NO: 45100 - DNA, 540 bp, Homo sapiens
  misc_feature: GYAE6OF02FGIAW.44.26.C04.1.454.CMB.1.raw
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccaggggaaacgccccctaaactccctagactctataaggcatctagtttggaaagtgggtccatcaaggttcagcggcagtggatcgtgggacagaattcgctctcaccatcagcagcctncagcctgatgatttgcttaacttattacngacctaacaattaattaatagtttttcgnggtacgttcggcgtaagggtactaagggtggaagttacgaaacgtacgtggtggctgaccacctagttcctggtactttcacttccgttaccccg

SEQ ID NO: 45101 - DNA, 530 bp, Homo sapiens
  misc_feature: GYAE6OF02GHTCW.44.26.C04.1.454.CMB.1.raw
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccagggaaagcccctaaactcctgatctataaggcatctagtttggaaagtgggtccatcaaggttcagcggcagtggatctagggacagaattcgctctcacatcagcagcctgcagcctgatgtatttgactaactttattactgaccaaactaatattaattagttttcgtagtacgttcggacgtaagggacttaagggtggaagtacaaacgtaacgtggtaggtactgaccacgtatctgtacttctactccttacccg

SEQ ID NO: 45102 - DNA, 624 bp, Homo sapiens
  misc_feature: GYAE6OF02IDDSH.44.26.C04.1.454.CMB.1.raw
  modified_base (196)..(196): a, c, t, g, unknown or other
  misc_feature (196)..(196): n is a, c, g, or t
tcagacagtatatacacgaccggtgctcgatttagtctagcgactttgggtttgggggagtcagacccagtcaggacacagcatggacatgagggtccctgctcagctcctgggactcctgctgctctggctcccagatactagatgtgacttccagatgacccagtctccatcctccctgtctgcatctgtgganacagagtccaccatcacttggccgggcagtcaggccaattagctaattatttagcctggtatcaagcaagaaaccagggaaacccttcctaaccctcctagtacttacttgcttcgctaattccctactttgactaattacgacgggttcccatccgttaccggttcacggcgacgtacggtaggtacgtcgtacggggaactacggtacttttctccttctacgtacccatcgacgctacgtccgtagtacgaccgtaggaaacgtagttcgttacgtacttaacgtttattacgttacgtaaactaaacgtaacctaacgtacgtaccgtaccctacaaccgttacgtttccggtacccgtacggtaacgtaaacgttaggaactaacaaccgtaaacggtctacggtgcctacgacctactaccg

SEQ ID NO: 45103 - DNA, 804 bp, Homo sapiens
  misc_feature: GYAE6OF02H28E5.44.26.C04.1.454.CMB.1.raw
  modified_base (225)..(225): a, c, t, g, unknown or other
  misc_feature (225)..(225): n is a, c, g, or t
  modified_base (379)..(379): a, c, t, g, unknown or other
  misc_feature (379)..(379): n is a, c, g, or t
tcagacagtatatacacgaccggtgctcgatttagtctagcgactttgggtttgggggtagtcgagacccagtcaggacacctagccagtggaccaagtcgtacgggtccccgtcgtcagctccgtgggctcctgcctgcgtcctcggctcccgaggtggccaaagtgtgacgtactcgagactgtaccgagtctccttccttcctgtcttctctgttggaggcngcgtcaccgtatcgacgttggcccggtgacgtacgtacggttcgttttcggcgtcgttcgttcgtccgttaggtttaccgaaacggtaaaaagggggcgtaaccggtacccccgttaacggttccgttacgttcgttcgtacgtacgaaaccgnggtacgtcggaacggtagaccgttcccgtacggacggttcgaggtcgaccgagtacccgagggtcggtaacggccggacgtccgaacgtactaccgacgtagtacggccgtaacgttggcccgggtaccgtaggtaacgtcgtttacgtacgtacccttaacgttttacgttccgtacgtaccgaacgtactaggttaacacgttaacgttacgttccgtaccccgttattaccggtttaccgggaccggtacgggtaacctacgggtacgttaaacggtaaaccgtaaccgaaaccggtaacggttcggttaacggtaccgtaccggtacccgtaccggtccgttaccgttacggttcctttaaccgtaccgtttccccggtaccccgttaccttaccggtttccgttacgttaagtttacccg

SEQ ID NO: 45104 - DNA, 631 bp, Homo sapiens
  misc_feature: GYAE6OF02IT3T8.44.26.C04.1.454.CMB.1.raw
  modified_base (284)..(284): a, c, t, g, unknown or other
  misc_feature (284)..(284): n is a, c, g, or t
  modified_base (442)..(442): a, c, t, g, unknown or other
  misc_feature (442)..(442): n is a, c, g, or t
tcagacagtatatacacgaccggtgctcgatttagtctagcgactttggggtttgggggagtcagacccagtcaggacacagcatggacatgagggtccccgctcagctcctggggctcctgctgctctggctcccaggtgccaaatgtgacatccagatgacccagtctccttccttcctgtcttcttctgttggaggcagcgtcaccatcacttgccgggcgagtcgaggttcgttttcggtgtctgttcgccttggtttaccaaaacggaaaaaggggggngacggaccccctaaggtccctcgtctctcgtagaaaccagacgtggaaggtagacgtcccgtcaggtcagtcgccagtccgagggtggtggggccggagtcccacgtctcgacctattacgccgacctgccggcctagaagtcttctgactaactttntttctgtacagtctagtatctaatcgtccgtcccgttctacgtttcggaccgtaacggggtacctaacggtcgtaaggaaacttaccgaaacgtacgtggtacgtactacgacctaccgtaattccgttaggttcctttacgacctttccccgttaccccgaccttaacttacctaacgttattaaccg

SEQ ID NO: 45105 - DNA, 255 bp, Homo sapiens
  misc_feature: GYAE6OF02FTPTO.44.26.C04.1.454.CMB.1.raw
  modified_base (252)..(255): a, c, t, g, unknown or other
  misc_feature (252)..(255): n is a, c, g, or t
tcagacagtatatacacgaccggtgctcgatttagtctagcgactttgggtttgggacagaattcgctctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnnn

SEQ ID NO: 45106 - DNA, 621 bp, Homo sapiens
  misc_feature: GYAE6OF02HV7NA.44.26.C04.1.454.CMB.1.raw
  modified_base (336)..(336): a, c, t, g, unknown or other
  misc_feature (336)..(336): n is a, c, g, or t
tcagacagtatatacacgaccggtgctcgatttagtctagcgactttggggtttgggggagtcagacccagtcaggacacagcatggacatgagggtccccgctcagctcctggggctcctgctgctctggctcccaggtgaccaaatgtgacatccagatgacccagtctccttccacctgtctgcatctaggaggagacagatccacatcacgttgccggacagtcagatatagtagtggtgctggtatcagcaacgaaacgagggaaacaccctaaactctgactataagtaagcatcgttagttaggaacgttcggtcatacgaagttgagnggcaggtagactgtacggaacagtaacttcgctctacacgatcgagacgagtactggacacgtaccgtagtaacttagtagtttttacgaacttaacctttaacgttacctacgtaacctaaactaaatttaatttaacgtttacgttttttacgggacggttaaccgttaccgggacctaaagggtaattacggtagtaacggtaacgtaaccgtaacgtaacgtcggtagtacgtacgtaccgtaactacgtacgtttaccgtattaccgtaacgtttccccg

SEQ ID NO: 45107 - DNA, 615 bp, Homo sapiens
  misc_feature: GYAE6OF02F4XGB.44.26.C04.1.454.CMB.1.raw
  modified_base (274)..(274): a, c, t, g, unknown or other
  misc_feature (274)..(274): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtagttggttggcctggtatcagcagaaaccagggaaancccctaaactcctgatctataaggcatctagtttggaaagttcggggtaccctatcgaaggttcagcggcgaggtgatcgngggacagaacttcgctcncacatcagcagcctgcacgctagacttgtattttagacttaaactttacttactcgaacctaaactaaattaattaaagttacgttttttacgggtaggttaaccggtttaccgggaaccgtaaaggggtaaccgttaaagggtaggtaaacggttacctaaacggtaagttcggttacggacgttacgtaaccgaccgtaattaccgttagttaccttacgttaccttccgttaacccccg

SEQ ID NO: 45108 - DNA, 567 bp, Homo sapiens
  misc_feature: GYAE6OF02GLJB5.44.26.C04.1.454.CMB.1.raw
  modified_base (222)..(222): a, c, t, g, unknown or other
  misc_feature (222)..(222): n is a, c, g, or t
  modified_base (446)..(446): a, c, t, g, unknown or other
  misc_feature (446)..(446): n is a, c, g, or t
tcagacagtatatacacgaccggtgctcgatttagtctagcgactttgggtttgggggagtcagaccctgtcaggggacagcatggacatgagggtccccgctcagctcctggggctcctgctactctggctccgaggtgccagatgtgacatccagatgacccagtctccatccctcctgtctgcatctgtcggagacagagtcaccatcacttgccgggnaagtcagagcattaggaacttctttaaatgtatcagcagaggcagggaaagcccctacaactcctgatctatgctcgcgtacctattttgctaaaggtcgggggtcccatcgaaggttacagtggcaggtggatcgtagggacagtatttcacttctccgactactctccgagttctcgacctaacctgtaacgttattttgactaactttactactgtacaanagtattactactcgtacccgttactacggttttgggaccgggtaactacgtgtacggtagtacgtaaccaaaccgtaacgttgtcggtactacgtaccaccgtacttcgtacttcgttacc

SEQ ID NO: 45109 - DNA, 668 bp, Homo sapiens
  misc_feature: GYAE6OF02ITG9B.44.26.C04.1.454.CMB.1.raw
  modified_base (280)..(280): a, c, t, g, unknown or other
  misc_feature (280)..(280): n is a, c, g, or t
tcagacagtatatacacgaccggtgctcgatttagtctagcgactttgggtttgggggagtcagacccagtcaggacacagcatggacatgagggtccccgctcagctcctggggctcctgctactctggctccgaggtgccagatgtgacatccagatgacccagtctccatccctcctgtctgcatctgtcggagacagagtcacatcacttcgccgggacaagtcagagcattacggaacttactttaaatggtatcagacagaggcgagggaaacncccctacgactcctgactctatgcgtcgccgtctatttcgacgtaaaggttcgggaccctagtacgtaacggttacgtaggtcggactacggttaggtacgttacgtagggacacgttaacgttcctaacgtcctactaccctattaccgaggtaccgtagttacctacgtaccgtaacctaggaacgttagtttaccgtacctaggttacctttaaatttcgtttaacgtaaccgtaaacgtaggtacgtagtaaacctagttaaccgtcccgttactaccgtttaccggtttaccgggacggggtaaacggtaccgttaattcgggtaacggtacgtaagtaaaccggtaacgggtaacgttcggttacgggtacctggtaacccg

SEQ ID NO: 45110 - DNA, 738 bp, Homo sapiens
  misc_feature: GYAE6OF02GNR0W.44.26.C04.1.454.CMB.1.raw
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
tcagacagtatatacacgaccggtgctcgatttagtctagcgactttgggtttgggggagtcagacccagtcaggacacagcatggacatgagggtccccgctcagctcctgggctcctgctgctctggctcccaggtgccaaatgtgacatccagatcgacccagtcctccttccaccctgtctgcatctgtaggagacagagtcaccatcacttcggccggcgagtctaggttcgttttcggngcgttgttcgtccttggttacgaaacggaaaaaggggngacggaccccgtaaggtcctacgtctcgtcgtacgaaaccagacgtaggtaacggtacgacgtacccggtcgtaggttcgagtcggaccgtaaggtccgaggggttcgggtacggggccggtacgtccctaccgtccgtcgaaccgtagttacggcccggtaccgtggcccggtacctaggtaacgtactttccgtaggtaccttaaacttttacgtttcgtcgtacgtaacgtcgtaagttaactcgttaacgttcgttacccgttcccccgttttagttacccggttttacgggcccggtaacggggtaacctaaccggtaccgttaaaggtaaaccgtaaacgtaaaccgggtaacgttccggtacggtaccgttaccggaaccctaccgttaacgttccgttacggttacccttacgtaccgtttccccgtacccgtcctacttcgtacgg

SEQ ID NO: 45111 - DNA, 530 bp, Homo sapiens
  misc_feature: GYAE6OF02GMXR7.44.26.C04.1.454.CMB.1.raw
  modified_base (412)..(412): a, c, t, g, unknown or other
  misc_feature (412)..(412): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccagggaaagccccctaaatcctgactctataaggcatctagtttggaaagtgggtcccatcaaggttcagcggcagtggatcgtgggacaggaattcgctctcaccatcagcagcctgcacgcctgattgtatttgacttaacttnttactgaccaataattatattagttttacgtgtacgttacgcgtaagggacgtaagggtcgaagtacaacgtagtcggtgctcgcaccgtntacgttntaccttcgtactcgtccccg

SEQ ID NO: 45112 - DNA, 590 bp, Homo sapiens
  misc_feature: GYAE6OF02HF6AA.44.26.C04.1.454.CMB.1.raw
  modified_base (202)..(202): a, c, t, g, unknown or other
  misc_feature (202)..(202): n is a, c, g, or t
  modified_base (400)..(400): a, c, t, g, unknown or other
  misc_feature (400)..(400): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagngtcaccatcacttgccgggccagtcagagttattagtaggttggttggccttggtatcagcaagaaaccgagggaaacgacccctaaactcctagatctaataaggcatcgttaaggtttaggaaaggttcgggtacctatcgtaaggttcgagcggacgaggtggactcggtagggacaggtaattcgctctcactntcagcacgctgacacgcctagatgttagtttcgacttaactttattactcgacctaaataattaattaatttaggttttcgtaggtacgttcggacgtaagggtacgtaagggtacgtaacgtacgtaaagtacgtggtcgacgtacgacctactacgttcttacgttctttacgtactcccgttacccg

SEQ ID NO: 45113 - DNA, 731 bp, Homo sapiens
  misc_feature: GYAE6OF02I38U5.44.26.C04.1.454.CMB.1.raw
  modified_base (185)..(185): a, c, t, g, unknown or other
  misc_feature (185)..(185): n is a, c, g, or t
tcagacagtatatacacgaccggtgctcgatttagtctagcgactttgggtttgggggagtcagacccagtcaggacacagcatggacatgagggtccccgctcagctcctggggctcctgctgctctggctcccaggtgccaaatgtgacatccagatcgacccagtctccttccacctatctncatctgtaggagacagagtcaccatccacgttcggcccgggaccagtcaggtacgtattaggttagttgggttggtccttgggtactctagcaacgaaaaccgaggggaaacgtcccccctaaaactcccgtagacttcgtaagtaaggctacgttcgttaaggttttagggaaagggttcggggttacccctaagttaccggtaaaggggtttccagggtaccgggacgtacgggtaggaacgttccggttaggggaaccaaggtaagttcccgtactccttccgtaacccaagttccaacggtcgaccttcccggtgacccggtacgtcccgttaggttagtacggtttaatttttcggaacctttaacgtttacttacgtacgtaccctaaaacgttaattaacgtttaattttacggtttttacgtagggttaccgttacggaccgtaacggggtaacgttaagggacgtaagtaccgaagtacgttgacgggtctcgaccacgtacgtttctaccgtttctacttacccgtttcctacccg

SEQ ID NO: 45114 - DNA, 512 bp, Homo sapiens
  misc_feature: GYAE6OF01A2LET.19.13.B02.1.454.CMB.1.raw
  modified_base (493)..(493): a, c, t, g, unknown or other
  misc_feature (493)..(493): n is a, c, g, or t
tcagtactctcgtgcacgaccggtgctcgatttagtctagcgactttgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaaggccgattcaccatctccagagacaattccaagaacacagtggatctgcaaatgaacagcctgagagctggggacacggctgtgtattactgtgcgagagcggctgggcaacgtacataccattacggttgacgtgtgggccaagggccaggtcatcgtctcccagcctccacaggcccagtcggtcttccccgtggccgccctgctcccaggancacctcgagcgcacgacgg

SEQ ID NO: 45115 - DNA, 525 bp, Homo sapiens
  misc_feature: GYAE6OF01A5B45.19.13.B02.1.454.CMB.1.raw
  modified_base (513)..(513): a, c, t, g, unknown or other
  misc_feature (513)..(513): n is a, c, g, or t
tcagtactctcgtgcacgaccggtgctcgatttagtctagcgactttgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaaggccgattcaccatctccagagacaattccaagaacacagtggatctgcaaatgaacagcctgagagctggggacacggctgtgtattactgtgcgagagcggctggcaactacatccattacggttggacgtctggggccaagggaccacggtcatcgtctccccagcctccaccaacgggcccagtccggtcttccccctggccgccctgcctccacggacgcaccctccganacgcgacgacgg

SEQ ID NO: 45116 - DNA, 609 bp, Homo sapiens
  misc_feature: GYAE6OF01EHI4D.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgcaggctccaggcaaggggctagagtgggtgcagttatatcatatgagtaggaaggtaaaatattattatggagactccgtgaagggccgattcaccatcctccagagactaacttccaaagaacaacagtaggatctgacaaatgaacagctagagagcgtggggacacggctgtagtattactgtgacgagaggcggctggacaacgtacactacctagtttacggtttgggacgttcgcggggaccgaacgggaccacggtcacgtccgtacctaccccgacgtccctaccgacccgaaccgggcccctaacggttcccggttcccttcccccgtcgggtcccgttcccgtgtcccgtccggacggaccgcccgtacccgtaccggaacgacgccaaccggtacccggg

SEQ ID NO: 45117 - DNA, 695 bp, Homo sapiens
  misc_feature: GYAE6OF01C9E08.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggcctccgaggcaaggggctaggagtgggtgcagttatatcatatgatggaagtaaaatatattatggagactcgtgaaggccatcacatctcagagaacatccaaagaacacagtggatctgacaaatcgaacagcctagacgaagcgtaggggaaccacggtctgtagtacgttacgtggtgacgagtacggcggtacgtaggactaaacgtactaacttaccgaacgttttacggttcggtacggttcggtacggggaccgtaacgggaccctaacgggtcaacgttccgtaccctacccccgacgtaccctacccgaacccggaaccgggtacccgtaacgttaccccgggttccccgttcccccccggttacgggcccccggtaacccccgtccggtaccccgttaaccccgggaacggtaccccggtaacccgtaacccccggtacccggtaccggaaccggacccgtaacccggtaaccccggggg

SEQ ID NO: 45118 - DNA, 625 bp, Homo sapiens
  misc_feature: GYAE6OF01CLRZF.19.13.B02.1.454.CMB.1.raw
  modified_base (173)..(173): a, c, t, g, unknown or other
  misc_feature (173)..(173): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgacttttgggttttcctcgttgctcttttaagaggtgtccagtgtcaggtgcacctggtggagtctgggggaggcgtggtccagcctgggaggtccctgagactctcctgtgcagcctctggattcaccttnagtagctttggcatcccacgtgggtcccgccaggcctccgaggcgaaggggctaggaggtggggtggcagttatatcatatgagtgggaagtaaaaatattattagtggagactccggtagaagggccattcaccatcctccaagagtaacaattccaaagaacacagtggatctagacaaatanaacagctagagagcgtagggacacggtctgttagtattacgtaggtcgacggagaggcggactggacaactacactacctaacgtttacggttacgggacggtacgtacggggaccgtaacgggaccgtacggtaccgacgtccgtaccctccccgacgcccttacccgaacggaacccggcccgtaaccgtccgtacccgttcccccgtacggcccgtccctgccctcgacggaccgccacccgtacgacgacgccgagacccggg

SEQ ID NO: 45119 - DNA, 620 bp, Homo sapiens
  misc_feature: GYAE6OF01DHFHY.19.13.B02.1.454.CMB.1.raw
  modified_base (337)..(337): a, c, t, g, unknown or other
  misc_feature (337)..(337): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctcctggcaaggggctaggagtgggtgcagttatatcatatgatggagtaaatatattatggagactccgtagaagggccgattcaccatctccagagacaattccaagaacacagtggatctgacaaatgaanagcctagagagcgtggggacacgggctagtgttaatacgtgtgacgagaggcggcgtggacaacgtactatacctagtttacgggttgggacgttcgtcgggaccgaacgggacccgacggtacacgttccgtccgtcccccgagtccccgtaccacccggtaaccgggccccgtaacgttcccgggttccccgttccccccgtcgggccccgtaccccgtcggtacccgtcccggtaacggaccgtaccgacccgttacccggagacgccaccggacccggg

SEQ ID NO: 45120 - DNA, 593 bp, Homo sapiens
  misc_feature: GYAE6OF01CFH71.19.13.B02.1.454.CMB.1.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
  modified_base (543)..(543): a, c, t, g, unknown or other
  misc_feature (543)..(543): n is a, c, g, or t
  modified_base (566)..(566): a, c, t, g, unknown or other
  misc_feature (566)..(566): n is a, c, g, or t
  modified_base (581)..(581): a, c, t, g, unknown or other
  misc_feature (581)..(581): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctggggacggtccctgagactctcctgtgcagcctctggattcaccttcagtagtctttggcatccacgtcgggtcccgccgaggcctccgagggacgaaggggctaggaggtgggtggctagttatatcatatgagtaggaagtaaaatatattanggagctcgtagaaggccgattccaccatctcaganaacactaccgaagaacanaggtgatctagactaaagtacgaactacgccgtagacgacgcggtacggggacacgggtnttaggtagttaattacgnggtgacggaggtacgcgggctggacctaaactcactccgtaagtttcgggttgacgttcggcgggacgaaggaccgngtacgacgtccgtccncccacgtcccaccacgacggcctgtccgtcctcccgngcccgtcctagcccgtcgcggancccgtaccgtcgganacgcgcgaccgg

SEQ ID NO: 45121 - DNA, 743 bp, Homo sapiens
  misc_feature: GYAE6OF01B6J2J.19.13.B02.1.454.CMB.1.raw
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtcggggtccgccaggcctccgagggcgaaggggctagaggtgggtggctagttatatcatatgagtaggaagtaaaatntatatgganactcgtagaaggcctatcacatcncagagactactccaagaacacaggtgatctagactaaagtagaacacgtaccgtagaagacggcggtaggggacctacgggcgttagttacgttagtttacgtggtcgacgggaacggacggccgggacgtacggacgtaaactaaccgtacgtaaccgttacggtttacggtttacgggtaccggttacgggtaccgggggaccgtaaccggggaaccctacccgggtaccgtacggtccccggttccctacccccgtaaccgccccgttaacccgacccggtaaccgggaccccgtaccgggttccccggttaccccgttccccccggtacgggtcccccgtaccccgtgtacccccggttccggaaccggtacccggtaccccgtaaccccggttacccgggaaggtacccggacccggtaaccggtaccccggggg

SEQ ID NO: 45122 - DNA, 813 bp, Homo sapiens
  misc_feature: GYAE6OF01CC6D8.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtcgtgggggaggcgtggtccagcctgggaggtccctgagactctcctgtgcagcctctgtattccaccttcagtagtcgtttggctactccacgtcgggtcccgccgaggcctccgaggcgaaggggctaggacggtggggtgctaaggttatactactattagtaggaagtagggtaaaaggttaaaaattagttaagttaagtacgggaacgtaccgttaccggtagggaacggggtaccctacttaccaacccgtatccgtaccgaagaacgtaacctaacttaccgaaaacgtaaccgaacgaggtagtacgtactacggaactaaagacgaacgtacggccgtaaggacgacgggtacggtacgggggaacgccggttagtacgttagttaacgtttacggtcggtacgggtagacggtacgggccggttacggtaccggtaacctaaccgtaacgtaccgttaccggttaaacgggttttacggggttacgggtaccggttaccggggtacggggaacccgaaacgggtccggtaacgtccgtacgttcccgtacccctaccccgtaccgaccccgtaccgaacccggtaaccgccccgttaccgttcccggttccccctcccccggtacggtcccccgtccgtacccggtccacccggtagacccctaccgaccctacggaccgacgccgtaccggacccggg

SEQ ID NO: 45123 - DNA, 775 bp, Homo sapiens
  misc_feature: GYAE6OF01C5478.19.13.B02.1.454.CMB.1.raw
  modified_base (327)..(327): a, c, t, g, unknown or other
  misc_feature (327)..(327): n is a, c, g, or t
tcagtactctcgtgcacgaccggtgctcgatttagtctagcgactttgggtttcctcgttgctctttaagaggtgtccagtgtcaggtgcacctggtggagtcgtgggggagcgttggccagcctgggacgtccctgagactctcctgtgcagccttcgtaggtacttccaccctttcgaagtacgtccgttttggacctattccccgacggttcgggtaccccgccagggtccctaccgaaggggaccgtaaagggggcctaagggaggttggggtaggacctaaggttataatcaagtaagtgaagtagggtaaagttaaaattntattagacggagtaccttacggtaggaacggtccgtatttaccacctatcctaccgaaggaacgtaacctaacttaacccgaaagaacctaacgtaggttacggaattcgtagaaacaaatacggaactaacgccgtaggaagacggtacggtaccggggaactacgggtacttagttacggttaactacgtggtcgacggtagacggccgtgtacgggtactaaccgttaccgtacttaccgtaacggtttacgggtttacgaaccgtttcgggaacgggacccaagggtacccgtacggttacacgttacccgcctaccccgaacgtcccgttaaccgaccgaaccgtcccgttagaccccgtttcccttcccggcgtacccgtccgtacgcccgtaccgggacgaccgccgtaaccccgtaggaacgttaccgcgaacgcccggg

SEQ ID NO: 45124 - DNA, 576 bp, Homo sapiens
  misc_feature: GYAE6OF01D9VSY.19.13.B02.1.454.CMB.1.raw
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggttttcctcgttgctcttttaataggtgtccagtgtcaggtgcacctggtggagtctgggggaggcgtggtccagcctgggaggtccctgagactctcctgtgcagcctctggattcaccttcagtagctttggcatccacgtgggtcccgccgaggctccgaggcgaaggggctaggagtgggtggctagttatatcatatgagtggaagtaaaatatattanggagactcgtgaaggccatcacatctcaganacattaccaagacacgagtgatcgtgacaaatgaacngcctagagagcgtaggggacacggtctgtagtattacgngtgacgagaggcgcgtgacaactacactactagtttacggttgacgttcgtcgggcgaacgggacctacggtcacgtcctcctcccgacgtccctaccgaccgaacggccctacgtcccgtcccttccccgtcggacccgtccctggccctaccgacgggccaccgtacccgtacggacgtcgccgcgtacccggg

SEQ ID NO: 45125 - DNA, 589 bp, Homo sapiens
  misc_feature: GYAE6OF01AV1P3.19.13.B02.1.454.CMB.1.raw
tcagtactctcgtgcacgaccggtgctcgatttagtctagcgactttgggttttcctcgttgctcttttaagaggtgtccagtgtcaggtgaacctggtggagtctggggaggcgtggtccagcctgggaggtccctgagactctcctgtgcagcctctggattcaccttcagtagctttggcatccactgggtccgccaggctccaggcaaggggctagagtgggtggcagttatatcatatgatggaagtaaaatatattatggagactccgtgaaggcctattcaccatctccagagacaattccaagaacacagtggatctgacaaatgaacagcctagagagcgtaggggacacggctgtagtattacgtgtgcgagagcggcgtggacaactacactcctagttacggttggacgtcggtacggggaccgaagggacccgtacggtactacgtcgtcctccccgacgcccgtaccacccgaacgggccccacgttcccggtcccttcccccgtcggcccgtccccgtcgtcccgtccgacggaccgccctacccgtccggacgaccgccaccgcggtcccggg

SEQ ID NO: 45126 - DNA, 758 bp, Homo sapiens
  misc_feature: GYAE6OF01CA9EI.19.13.B02.1.454.CMB.1.raw
  modified_base (263)..(263): a, c, t, g, unknown or other
  misc_feature (263)..(263): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (507)..(507): a, c, t, g, unknown or other
  misc_feature (507)..(507): n is a, c, g, or t
tcagtactctcgtgcacgaccggtgctcgatttagtctagcgactttgggttttcctcgttgctctttaagaggtgtccagtgtcaggtgcaccgtggtggagtcgtgggggacgcgtggtccagccgtgggagtcccgtgacgacttcctcctgtgcgacgtcctcgtggtacttcctacccttgagttagtcgtttggcctacgttccctacgtcgggtcccgaccgaggccctaccgaggccgaaagggggtcttaaggnggtaggggtcggtataagtttacattcagttagtggagtacgggtaaaagttaaaattgttaagttagacgggtaactacgttcggtaggaacgggacctataccaccgtacttcaccgtaagacgtaactactaccaaagacacgtagnggactcgagactaancgaacncgtactgacgacggtaccggtagggaacctacgtggttagttaccgttaagtcgtgacgtacggagtaccggngtcgacggtaaccttacgcgtaacgtacgttaaggttacggtacggtccggttacgggtaccgggaacggtaacccggtacggtaccggtacctaccgggttaccctccgacccgtcccgtaccgtaacccgacggtaaccggccttaccggtcccgttcccgttaccccgggcgtccccgtccgaccgaccggttccgacgttacccgtacccacccggttacaccggaaaccgccgaacggtccccggg

SEQ ID NO: 45127 - DNA, 773 bp, Homo sapiens
  misc_feature: GYAE6OF01EMVNQ.19.13.B02.1.454.CMB.1.raw
  modified_base (380)..(380): a, c, t, g, unknown or other
  misc_feature (380)..(380): n is a, c, g, or t
  modified_base (758)..(758): a, c, t, g, unknown or other
  misc_feature (758)..(758): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtcccgccgaggcctccgaggcgaaggggctagaggtggggtggctagttatatcatatgagtagggaaagtaaaattatattagtaggagtaccgtccggtaggaacgggcctattccaccatcctaccgagacgactaacttaccaaagaaccacgtaggtggatcgtagaactaaagtgaacngaccgtagagcgcggtaggggaccacgggtctaggttagtatttacggtggtagacggtaaggcggccggtacgtacgggaacctaaacttacgtaacgttccgttaaagggttttaccggggtttacgggtacccggttacgggtaccggggggtacccgaaacccgggggttacccgtaccggttccgtaaccgttccccggtaccccgttaccccccgaggtacccccctaaccccggtaaacccgacccggggtaccccttacggttccccggttcccccgttacccccggtccgggtcccctccccggtacgtccccgtacccggaggtaccccgccccggttaaccccgtaccggaaacggacccggtaccncccggtacccggggg

SEQ ID NO: 45128 - DNA, 829 bp, Homo sapiens
  misc_feature: GYAE6OF01EDDLI.19.13.B02.1.454.CMB.1.raw
tcagtactctcgtgcacgaccggtgctcgatttagtctagcgactttgggttttcctcgttgcttcttttaagaggtgtccagtgtcaggtgcacctggtggagtctgggggagcgtggtccagcctgggaggtccctgagactctcctgtgcagcctctggtattctacccgttcagtagtcgttttggcactccgacgtgggtccgccaggctccgaggcgaagggctaggaggtgggtgactagttatatcattagtgagtaggtaaagttaaaattagttaagttagtaggaacgtaccgtaccggtagggaaccgggtccgtaattaccaaccctacgtccgttacccgaaggtaacgaacctaaactttaacccgaaacggaacctaacgaagggttacggtaacttaccgtagaaacctaaagtcgtaaaccacggtaccgtaggacggacggtaccggtaacggggaaccgtaccgggtgttacggtttaggttaacgtttacggtaggttcggacgggttaacgggcgggtaccggacggtaccgggaaaccttaaaccggttaacctaaccgttacccggtttaacgggttttaaccgggtttacggtaccgggttccgggtaccggggtacccgaacggggtaccgtaacggtaccgtaccgtccgtacccgacccgtaccgtcccttaaccgacccgtaaccggtaccctaccggttcccgttacccgtccccggtcggtccccgtacccgtcgttacccgaccggaccggtaccgaccccgtacccgtccggaacggtcgaccgtcggaccccggg

SEQ ID NO: 45129 - DNA, 778 bp, Homo sapiens
  misc_feature: GYAE6OF01A6AFT.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctggggggaggcgtggtccagcctggggaggtccctgagactctcctgtgcagcctctggattcaccttcagtagctttggcatccacgtcggggtcccgccgaggcctccgagggaccgaagggggctaggtaggtggggtggcagttatatcatatgagtaggaaggtaaaatataattagtgggagacctccggtggaacggggtccgatttaccaaccctattcctaccgaggaacgaactaaacttaccgaaaacgaaccacgaggtacggatcgtagaacaaatacgaaacacggactaggaagtacggacggtacggggacgaacgggtctggttacgttaattacggttcggtaggccggtaaggacggccggggtccgtacgggtacctaaaccgtaacgtaccgttacgttaacggttttaacgggtttcgggtaacggtaccgggttacggggaccggtaaccggggaacccgtacggtaccgtacgttccgttacccgtaccccgacccgtccccgtacccgaacccggtaacccgggtaccccgtacgttaccccgggttcccgttccccccggtccgggtccccgaccccggtccgtacccgtcccggaccggccgaccccggacccgttacccggaggaccgccccgtacgacccgggg

SEQ ID NO: 45130 - DNA, 671 bp, Homo sapiens
  misc_feature: GYAE6OF01E5P0A.19.13.B02.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggttttcctcgttgctcttttaagaggtgtccagtgtcaggtgcacctggtggagtctgggggagcgtggtccagcctgggaggtccctgagactctcctgtgcagcctctggattcaccttcagtagtctttggcatccacgtgggtccgccaggctccaggcgaagggctagaggtgggnggcagttantcattatgagtaggaagttaaaatatatatgganactcgagacgggccattccacagtcctacagacgacaactaccgaaagaacacgaggtggtanctagacaaagtgaacngtacgtgagngcgtaggggacaccggtntgttacgtattacgtggtgacggaacggtggcccggtacgcgggaacctaaccgttactaaccgttaccgttaaggttttaccgggttacgggccggttaccgggtacggggtacccgaaacggggtaacccgtacccggtcctaacggttcccgtaccccgtccccgtaacgtccccgtaacccgaacccggaccgggtccctaaccggttcccggtccccttccccgcggcccgtccgtacgtcccgtacgacggccaccgtccccgacggtacaccggtgaccgccgg

SEQ ID NO: 45131 - DNA, 662 bp, Homo sapiens
  misc_feature: GYAE6OF01D2VJG.19.13.B02.1.454.CMB.1.raw
  modified_base (181)..(181): a, c, t, g, unknown or other
  misc_feature (181)..(181): n is a, c, g, or t
  modified_base (511)..(511): a, c, t, g, unknown or other
  misc_feature (511)..(511): n is a, c, g, or t
  modified_base (538)..(538): a, c, t, g, unknown or other
  misc_feature (538)..(538): n is a, c, g, or t
tcagtactctcgtgcacgaccggtgctcgatttagtctagcgactttggagtttggggctgggcctaaggaagcagcactggtggtgcctcagccatggcctggaccgttctcctcctcggcctcctctctcactgcacaggctctgtgaccctcccatgtggtcgactcagccacccttnagtgttcagtgccccaggagagacggccaggtattcccgtggtggggagacactttagatagtaaaacgtgtgcctacgtcggtacaggcagacgccgaggccaggcccctatactgctatctagttataacgtaccgtccggcctcgtaagggctcccgtagacgcgactcctcgtacggctacctaactcgtaccgggaaccaccgggtacccacctcgggaccgttacgacggtccgtaacgggtacgaacgggcccggggtagtacggtacgggaccacgtacgtttacgtggtaccagggttgtacggtagttaggtagtaaggngtacgagttcgtagttacggtttcggngggtaccggaacgtacgcgttacggaccgtcgtaacggtccgtacggaccgtaacgccgttaccgtcccccgttacggtcctaccgtctacccggttaccccaccccgttcaccggtaacccgg

SEQ ID NO: 45132 - DNA, 862 bp, Homo sapiens
  misc_feature: GYAE6OF01B7R9H.19.13.B02.1.454.CMB.1.raw
  modified_base (174)..(174): a, c, t, g, unknown or other
  misc_feature (174)..(174): n is a, c, g, or t
tcagtactctcgtgcacgaccggtgctcgatttagtctagcgactttgggttttcctcgttgctcttttaagaggtgtccagtgtcaggtgcacctggtggagtcgtgggggaggcgtggtccagcctgggaggtccctgagactctcctgtgcagcctgtggtattcaccttnagtagtctttggcatccacgtgggtccgcgaggcctccgaggcgaaggggctaggaggtgggtggctagttatatcatagtgagtaggaaagttaaaatagttaattagtggaacgtaccgttaccggtaaggaaacggggtacccttaattaccgaaccctaagttcccgtaccgaacgtaaacgaaccttaacgttacccgaaaagaaaccgtacgtagggtaggtacttccgtaacggaactaaaagtacggaaaccacggttaccgtaggaacggtacgggtaccggttaacgggggaacctaccgggttacgtttaggttaccgggtttaaacttttacggtagggtaccgggtacgggaagggtaccggtccggtaaccgtacggaacccgtaaacttacgtaacgttaccgttaaggttttaccgggttcggtaaccggttacggtacggggtaacccgtaaggggtaccccgtaacgggtccgtacgttaccccgttccccgtaaccccgtaccggtacccgtaccccgaaaccggtaaccccggggacctaaccggtttccccggtaccccgtttcccccggtagggtcccccgtacccgtccggacccgttccggaacccggtcccgtacccgtaacccggtccgggaagacccgttacccggacggttaccccgggg

SEQ ID NO: 45133 - DNA, 724 bp, Homo sapiens
  misc_feature: GYAE6OF01A7O7R.19.13.B02.1.454.CMB.1.raw
  modified_base (274)..(274): a, c, t, g, unknown or other
  misc_feature (274)..(274): n is a, c, g, or t
tcagtactctcgtgcacgaccggtgctcgatttagtctagcgactttgggttttcctcgttgctcttttaagaggtgtccagtgtcaggtgcacctggtggagtcgtggggggaggcgtggtccagcctgggaggtccctgagactctcctgtgcagcctctggattcaccttcagtgtctttggcatccacgtgggtcccgcaggctccgaggcgaaggggctaggaggtggggtggctagttatatcatatgatggaagtaaatatattagnggtagacgtcgtaggaagggccgtattccaccatcctccgaagacgaactaattacccgaaagaaccacgaacggtgactcgtagacaaagtgaacagcctagacgaggcggtagggaccgagggcgttgtagttagttacgtggtaggcggagcggcggtcgtcgggactaactaccgtaacttaccgtaaggttttccggggttacgggtccgtttaccggggacggggaacccggaaccggggtaaccccggtaccgggtaccttaccggttcccgtacccctaccccccggaccgttacccccgtcccgaaacccgggcccgggacccttacccggtcccgggttccccctttccccccggtacgggtccccccgtccgtccgcccggttaccggacggtacccgacccgtacccgtaccggagcccgtaccgcccgtacccgggg

SEQ ID NO: 45134 - DNA, 742 bp, Homo sapiens
  misc_feature: GYAE6OF01B7QDM.19.13.B02.1.454.CMB.1.raw
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagtactctcgtgcacgaccggtgctcgatttagtctagcgactttgggttttcctcgttgctcttttaagaggtgtccagtgtcaggtgcaccgtggtggagtcgtgggggaggcgtggtccagccgtgggaggtccctgagactctcctgtcgcagcctcgtggacttccaccttcgagtagcctttggctactccacgtcgggtcccnccgaggtcctccgaggcgaaggggctaagggnggtggggtcgntaagttagtatacgtatagtgaagtagggtaaagtaaaaattataagttaagtaggtacgtacgtccggtaaggaacgggtacctaataccgacctattccgaaccgaagtaaccgaaactaaccgttaaccaaaacgtaaccgaacgtaggtagtaacgttcaacggtaacaagacgtaacgacgtacgagaggtacgcggagggacgtaccgtgttggtacttacgttacgtgggcggtacgaagcggacgggtacgacgtaaccgaacctagtaaccgtaccgttaggttaaccggtttagaaccggttaggaccggtaacggaccggaacgtcggtacgtacgttcccgacccgacccggtactccccgaaccgaccgtaccggtacccgtaccgttccggtcccccttccggacccggttcccgcccgtagtcccgtccggaacggtcacccgtacccgacgacgcgtaaccgccgaccggg

SEQ ID NO: 45135 - DNA, 619 bp, Homo sapiens
  misc_feature: GYAE6OF02GTN7K.19.13.B02.1.454.CMB.1.raw
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagtactctcgtgcacgaccggtgctcgatttagtctagcgactttgggttttccgtcgttgctcttttaagaggtgtccagtgtcaggtgcacctggtggagtctgggggaggcgtggtccagcctgggaggtccctgagacttctcctgtgcagtcctctggattctaccttcagtagctttggcatccactgggtccgccgaggctccgaggcaaggggctagagtgggtggctagttanatcatatgatggagtaaatntattatggagactccgtgtaagggccgattcgaccgatcctccagcgaacattaccgaagtaacaccgaagtggatcgtagctaaatagaactagcctagagagagtggggacacggctgtntattactgtcgngtagagcggtctggctaacgtacagtacctagttacggttacggtaccgtacgtcgggacctaacgggtacctacggtcacgtccgtcctccccgacgtacctcccgaccgtaaccgggccctaacgtccggtaccttccccgcggtacccgtcccgttccgaccgtcccggtacggaccggtcctacccggttccgacggtacgtaccgacctacccggg

SEQ ID NO: 45136 - DNA, 549 bp, Homo sapiens
  misc_feature: GYAE6OF02I8YBA.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaatatattatggagactccgtgaagggccgattcaccatctccagagacaattccaagaacacagtggatctgacaaatgaacagcctagagagcgtaggggacacgggctgtgtattacgtgtgcgagagcggctggcaactacatcctattacggttggacgttcgtggggaccaagggacctacggtcatcgtacctcccacgcctccgaccgaacgggcccagtccggtcccttccccgtcggccgccctcgcctccgacggacgccaccgtccggagcgaccacgaccggg

SEQ ID NO: 45137 - DNA, 642 bp, Homo sapiens
  misc_feature: GYAE6OF02H1HOF.19.13.B02.1.454.CMB.1.raw
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (384)..(384): a, c, t, g, unknown or other
  misc_feature (384)..(384): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctaggagtgggtggcagttatatcatatgatggaagtaaaatatattatggagactcgtgaaggcgattcacatctcaganacaataccaaagacanagtagatntagacaatcgaacacgccgtagagagcggtagggaacgacggtcgtgtagttacttagtggngacgaggacgcggcgtacggactaacgtactactacttacggtttacgggtttaggtacggttcggtacggggaccgaacgggaccgtacggtacctacgtaccgtacccgttaccccgaccgtacccctacccgtaaccgaacccgggtaccctacgtccccggttccccttccccggtcggccccgtcccgtccgtacccgtaccgacggacccgtacccgacccgtaccggaacggaccgtaccgacctaccggg

SEQ ID NO: 45138 - DNA, 559 bp, Homo sapiens
  misc_feature: GYAE6OF02HUKH8.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaatccaagaacacagtgatctgcaaatgaacagcctgagagcgtaggggacacggctgtgtattactgtcgcgagagcggcgtggacaactacatacctagttacggtttcggacgttcgtggggaccaacgggaccgacggtaccagtccgtcctccccagtcccgtcccaccgaacgggcccacgtccggtcccttccccgtcggccgccctccgcctcccgaggaccgcgacccgccgagacgcacgaccgg

SEQ ID NO: 45139 - DNA, 795 bp, Homo sapiens
  misc_feature: GYAE6OF02G3HZT.19.13.B02.1.454.CMB.1.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
tcagtactctcgtgcacgaccggtgctcgatttagtctagcgactttgggttttcctcgttgctcttttaagaggtgtccagtgtcaggtgcacctggtggagtcagggggaggcgtggtccagcctgggaggtccctgagactctcctgtgcagcctctggattcaccttcagtagctttggcatccactgggtccgccaggctccaggcaaggggctagagtgggtggcagttatatcatatgatggagtaaatatattanggagactccgtgaagggccattcacatctcagagactaattccaaagaacacagtggatctagcaaangaacagcctagagagcgtaggggacacggctgtagtactaacgtggtcgtacggacgtaggcgggtacgttacgggacctaaaccgtacgtaacgttaccgtaaggttttaacccgggttttagggtaacccgggttaccggtttacggggggaacccccgttaaaacggggggtaaccccgtaaacggggtttacccgtaaacggtttccccgggttacccgttacccccccgtaaccggttaccccccgttacccgtaaacccccggtaaaacccgggggtcccccgtaaaacggttccccgggtttaccccgttttaccccccccgggttaggggttaccccccggtcccccgttaccgggtaccccgttaaccccggtaaccggggtaaccggttaacccccgtaaccccgttacccgggaaccggtaacccgggtacccgaacccggtaaaccccgggg

SEQ ID NO: 45140 - DNA, 597 bp, Homo sapiens
  misc_feature: GYAE6OF02JB9YQ.19.13.B02.1.454.CMB.1.raw
  modified_base (258)..(258): a, c, t, g, unknown or other
  misc_feature (258)..(258): n is a, c, g, or t
  modified_base (373)..(373): a, c, t, g, unknown or other
  misc_feature (373)..(373): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggagtaaaatntattatggagactccgtgaagggccgattcacatctccagagacaattccaagaacacagtgatctgacaaatgaacagcctagagagcgtaggggacacgggctgtgtattacngtgcgagagcggctggacaactacatccagttacggttggacgtcgtgggaccaagggaccacggtcagtccgtcctaccccgacgccctacccgaaccgtaaccgggcccctaagtcccgggttacccttcccccggtaggccccggtccccgtcgcccttacccggaacggtaccgacccgtacccgtacccggaacggtaccgcccgtaaccgacccgggg

SEQ ID NO: 45141 - DNA, 649 bp, Homo sapiens
  misc_feature: GYAE6OF02GD1DN.19.13.B02.1.454.CMB.1.raw
  modified_base (328)..(328): a, c, t, g, unknown or other
  misc_feature (328)..(328): n is a, c, g, or t
tcagtactctcgtgcacgaccggtgctcgatttagtctagcgactttgggttttcctcgttgctcttttaagaggtgtccagtgtcaggtgcacctggtggagtctggggggaggcgtggtccagcctggggaggtccctgagactctcctgtgcagcctctggattcaccttcagtagctttggcatccactgggtcccgccaggcctccaggcgaagggggctaggaggtgggtggcagttatatcatatgagtaggaaggtaaaatataattatggagactccgtagaaggccattcacatctcagagacatccaagaacacagnggatctgacaaatgaaacagcccgtagaaggagcggtaggggaccacgggtctaggttgttaacttacgtggtcggacgaggtacggcggcgtagacgtaaaccgtacactaccttacgttaacgggtttggaccggttcggtacgggaccgaaacgggaccgtacggtacgacgtccgtaccgtccccgacgtcccgtacccgaacccggaacggcccgtaaccgttccggtcccttacccccgtcggacccgtcccgtaccgtcccgtaccgacgggacgacccgtacccgtcccggacggaccgaccacgtacccggg

SEQ ID NO: 45142 - DNA, 629 bp, Homo sapiens
  misc_feature: GYAE6OF02GBUFJ.19.13.B02.1.454.CMB.1.raw
  modified_base (258)..(258): a, c, t, g, unknown or other
  misc_feature (258)..(258): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaaatntattatggagactccgtgaagggccgattcaccatctccagagacaattccaagaacacagtgatctgcaaatgaacagcctgagagcgtaggggacacggctgtgtattactgtcgcgagagcggctggcaactacactacctagtttaccgggtttggaccggttcgttacggggaccgtaaacgggtacccgacgggttccaacgttccggtccctcccccgacgtccccttaccgaacccgaaacgggtccccaacttccggggtccctttacccccggtacggccccggtcccgtccggtcccttacccggacgggtaccgacccgtaccccgtacccggtaacgaccggtaccaccgtacccggg

SEQ ID NO: 45143 - DNA, 556 bp, Homo sapiens
  misc_feature: GYAE6OF02GPE2I.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgacaaatgaaacagcctgagagcgtggggacacggctgtgtattactgtgcgagagcggctggacaactacatccagttacggttggacgttcgtaggggaccaagggaccacggtacagttcgtcctccccagccctaccaccgaacggcccaagtccggtcccttccccgtcggcccgtccctcgccctccgacggacgccacccgtccgaggacgaccgacgacgg

SEQ ID NO: 45144 - DNA, 621 bp, Homo sapiens
  misc_feature: GYAE6OF02IOIBQ.19.13.B02.1.454.CMB.1.raw
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
  modified_base (596)..(596): a, c, t, g, unknown or other
  misc_feature (596)..(596): n is a, c, g, or t
tcagtactctcgtgcacgaccggtgctcgatttagtctagcgactttgggttttccctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggctccgaggcaaggggctagagtgggtggcagttanatcatatgatggaaggtaaaatatattatggagactccggtagaacgggccgtattccacatctcaganacaactacaaagaacagagtgatctgacaaagtgaaacagtccgtagacgagcggtgggaactcggcgtgtagtaattacgtggtcgagtagaggtcggtcgtcggaacaaactacgtactaccttaaggtttacggtttagggtacgttcggtacggggaccgtaacgggacccgtacggtaccgtacgttcccgtaccgtaccccacgtaccctaccgaaccgaaccgggaccctacgttccgtcccgttccccgtcggcccgcccgtcgccgtaccgacggacnccgacccgtcgacgaccgcacgcgg

SEQ ID NO: 45145 - DNA, 621 bp, Homo sapiens
  misc_feature: GYAE6OF02GRRKE.19.13.B02.1.454.CMB.1.raw
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccgaggcaaggggctaggagtgggtggcagttatatcatatgagtggaagtaaaatatattatgganactccgtagaaggcgatcacatctcagagactactaccaagaacanagtgatctagacaatgaacncgactgagagcgagggacacggtctagtntacttacgtgtcgagagcgcggcgtgacaactanactcctagttacggtggacgttcgtacgggacgaacggaccgtacgtactacgtccgtccctaccccgacgtaccctacccgaaccgtaaaccgggccctaaccggttcccgttacccgttacccccgtccgggtcccgtccccgtccgtcccgtacccggacgggtaccgacccgtacccggttacccggaaccggtacggacccgaaccggtacccgg

SEQ ID NO: 45146 - DNA, 760 bp, Homo sapiens
  misc_feature: GYAE6OF02JEYS4.19.13.B02.1.454.CMB.1.raw
  modified_base (311)..(311): a, c, t, g, unknown or other
  misc_feature (311)..(311): n is a, c, g, or t
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggctccaggcaaggggctagagtgggtgcagttatatcatatgatggaagtaaatatattatggagactccgtgaaggcattcaccatctcagagactatccaagacanagtgatctgacaaagtcaacgacgcctagagtacgacggtagggggaaacgtcgtagtacggttaattaccgtaggtacgtacggaacggtacgggaccgggcgttacgggaccgtaaaccgtaaccgtacgttacccgttaaggtttaccggggtttacggtaacggttccggttacgggggacccgtaaacggggaacccgtacggggttaccacgtttacccgttacccgttaccccccgtacggtacccccgtacccggtaacccggtaaccggggtccccctaaacggttcccccgggtttaccccgtttccccccccggttcgggtacccccgggtaccccccgtcgggtaccccgtaacccggtaaccggggtacccgtaccgtaaccccccggttaccggaaccggaccggtaccctaccgggacccggtaccccccgggg

SEQ ID NO: 45147 - DNA, 808 bp, Homo sapiens
  misc_feature: GYAE6OF02HMO8V.19.13.B02.1.454.CMB.1.raw
  modified_base (278)..(278): a, c, t, g, unknown or other
  misc_feature (278)..(278): n is a, c, g, or t
tcagtactctcgtgcacgaccggtgctcgatttagtctagcgactttgggttttcctcgttgctcttttaagaggtgtccagtgtcaggtgcacctggtggagtcgtggggggaggcgtggtccagcctggggaggtccctgagactctcctgtgcagcctctggattcaccttcagtagctttggcatccacgtcgggtccgccaggcctcccgaggacgaagggggcctaaggaggtgggtggctagttatatcatatgagtggaaggtaaaattntaattagaggatacctcggtagaacgggccgtattaccgacctatccacgagaaccgtaactaccgtaaccgaaaacgtaacgaccgtaagggtacgtacgtaccgtagaaactaaagtaacgaaaccgacgtacgtaggaacggacggtacggggtacgggaacccggtcggtacgtttacgggttatttaaacgttcggtaggacgggtacgtaacggggcgggtacgggtacgtaacgggaacctaacgtacgttaaaccgtaccgtttaagggttttacccgggtacggtccggttaaccggggtcggaaacccgggttacggaccgtaaccggtacctccggtaccccgttacccctacccgtccgtaaccgtaaccccgtaaccgggacccgtacctccggttaccccggtttccccctcccggggacccggtttccccggccttccccgtacgggtacccgtaacgggccctttaaccccggaacccggtaccggacggaccccgacgtacccgggacccggg

SEQ ID NO: 45148 - DNA, 787 bp, Homo sapiens
  misc_feature: GYAE6OF02GC8XM.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctggggggaggcgtggtccagcctgggagtccctgagactctcctgtgcagcctctggattcaccttcagtagtctttggcactccacgtgggtcccgccgaggcctccgagggcgaaagggggcctaggaggtggggtgactaggttatatcgatactgagtagggaaagtaaaattattaattagtaggaagtacgtccggtaggaacggggtccgtaattaccgaacctacttacctccgaagacgaaactaacttacccgaaagtaaccacgtaaggtacggtactcgttcggaactaaagttaggaaaccacgaccgtaagaacgtacggtcgtaacgggggacaccgggtactggttacgttaacgttaagtcggttacgaggtaaggtacggacgggtcgtacggacgaaccgttacgtacttaccgtaacgtttacgggttacggtaccggttacgggtccggggtaccggaaacgggtacccgtaccgggtaccgtacgttaccgtacccgtaccccgacgtaccctacccgaacccgaccggtaccgtaccgtaccggttccccgttccccggtacggtccccggtccctacccggtccgtacccggaaccggtaccgtacccgtaccccggttacggaaccggtaaccggaccgtacccggtaaccccgggg

SEQ ID NO: 45149 - DNA, 544 bp, Homo sapiens
  misc_feature: GYAE6OF02FJFPI.19.13.B02.1.454.CMB.1.raw
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
  modified_base (517)..(517): a, c, t, g, unknown or other
  misc_feature (517)..(517): n is a, c, g, or t
tcagtactctcgtgcacgaccggtgctcgatttagtctagcgactttgggttttccgtcgttgctcttttaagaggtgtccagtgtcaggtgcacctggtggagtctgggggagcgtggtccagcctgggaggtccctgagactctcctgtgcagcctctggattcaccttcagtagcctttggcatccactgggtccgccaggctccaggcaaggggctagagtgggtgcaggttatatcatatgatgggaggttaaaanatattatggagactccgtgaagggccgattcaccatctaccanacgacaatttcccaagtaaccacagtggatactgcaaatgaacagcctgagagctgggacacggctgtgtagtactggtcgacgngtagcgctaggcaactacatccaagttcggttggacgttcgtagggccgaaggaccaggtcaagtccgctcccagcctccaccgacgccntccggtccttccccgngccgtcccagccgtccgaggcnccgtaccgccgtacgcgtacacaccgg

SEQ ID NO: 45150 - DNA, 676 bp, Homo sapiens
  misc_feature: GYAE6OF02J1UUD.19.13.B02.1.454.CMB.1.raw
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
tcagtactctcgtgcacgaccggtgctcgatttagtctagcgactttgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccacgtgggtccgccgaggcctccgaggcgaaggggctaggagtgggtgccagttatatcatatgagtagggaagtaaaatattaattagtaggagaccgtcgtaggaacgggccgtaattcaaccagttctcccgaagacgaactaatacccaaaggaacacgtaagtcgggatcgtgacgtaaaangaaacgtacgactgaacgacgcggtaggggaacncggntggtagtatttacgtgtcgcgaagcggcgtcgnggtacgaactactacgtaccgttagtttacggttacggaccggttcggttacggggaacgtacgggaaccgtccggtataccgttcgtacccctcccggaccgtacccgtacccgaaaccgtaccggccctaacgttcccggttccctccccgtaggtcccgcccgttcgccgtaaccgacggtacccgacccggttccgaccggaggtacccggacgtacccggccggg

SEQ ID NO: 45151 - DNA, 852 bp, Homo sapiens
  misc_feature: GYAE6OF02I6SIK.19.13.B02.1.454.CMB.1.raw
tcagtactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggctatccacgtgggtcccgccgaggcctccgaggcgaaggggctaggaggttgggtgcagttatacgtcaatagtgagtagggtaaacggttaaaatacgttaagttagtagggaacgtaccgtaccgggttaggaaacggggccgtaacggtttacaaccctacgttaaccttcccgaaaggaacggaaaccgttaaacgtttacccgaaaacggaaaccaacggaaaggttcgggaaacttcgtcgaactaaaacgttagaaaccgaacggtcccgttagggaacgtaacggtccgggtaacgggggtaaccgtaacgggtccgttggttacgtttaaacgtttagtcgggttacgacggtaggacggcgggtaccgtacgggaccgtaaccgttaaaccgacgttaccttaacggtttaccgggttcggtaccggttacggttcgggggaccgtaaaccggggtaaccgtaccgggtaccgtaacgttccggttaccccttaccccgaccgttaccccgtacccgaacccgtaacccgggtacccctaaccgttccggggttacccctttcccccggtaaggtccccgtacccgtccggtcccgtaccgaccgggacgtaccccgaccggttacccggaacgtacggtaccccgacgtaccccgggg

SEQ ID NO: 45152 - DNA, 646 bp, Homo sapiens
  misc_feature: GYAE6OF02FJTDQ.19.13.B02.1.454.CMB.1.raw
tcagtactctcgtgcacgaccggtgctcgatttagtctagcgactttgggttttcctcgttgctcttttaagaggtgtccagtgtcaggtgctacctggtggagtctgggggaggcgtgggtccagcctggggaggtccctggagactctcctgtgcagcctctggattcaccttcagtagctttggcatccactgggtccgcaggcctccaggcaagggggctagagtggggtggcaggttatatcatatgatgggaggtaaaatatattatggagaccttccgtgaaggggccgattccacccatcctccaagagaacaacttccaaagaacctacagtggattctaggacaaaatgaaacagccctgacgagcgaggggacacggctggttatacgttaactcggtgcgaggagtcggctggacaacgtacaactcctaacgtttaaccggttcggtaccggttcgtacgggggaccaacgggtaccctacgggtacctacgttaccgtcctaccccgacgtacccttaccgaacccgaacggaccccgagttcccggtccttacccccgcggaccgtcccctggacccgtacccgacggacgcccgtaacccgtacccggacgaccgtactacccgtaccgg

SEQ ID NO: 45153 - DNA, 1047 bp, Homo sapiens
  misc_feature: GYAE6OF02GM6NP.19.13.B02.1.454.CMB.1.raw
tcagtactctcgtgcacgaccggtgctcgatttagtctagcgactttgggttttccgtcgttgctcttttaagaggtgtccagtgtcaggtgcacctggtggagtctgggggaggcgtgggtccagcctgggagtccctgacgactctcctgtgcagcctctggattacaccttacgagtagtctttggctagtccacgtcgggtccgccgaggcctccagggcaagggggctaggacggtggggtcggcgtaaggttactactactaacagtagacgttaagggaaagggttaaaaattagttaagtttaagtacgggtagtaacccggttaccggtaaggaaccggggtccgtaacgttccgtaaccttaacttacccgttcccaaggtaagaaccgtaaacctttaaccgaaaacgttaaaaccgaccgtaaggtcgggtaactaccggttaacgaacgttaaaacgtacggtaaaacgaccggaccggttaggaacggaccggtacgggtaccgggggtaccgtaaccgggtacggtttaacgggttacgtttaacgtttaccggttagggttacgggtaaccggggtaaggggtaccgggtacccggggtaccgttaacccgggggaaaccttaaccggtaaaccctaaccgtttaccccggttaaacggtttttccggggggtttaaacggttaacccgggttaccggggttacccggggtaaaccgggggtaaaaccgggtacccgggttaaccggttaccgggtaacccggtttacccggttaaccccgtaacccccggtaccgggttcccccgaacccccggttaacccggggtaaaaccccggaccccggttaaaccggtttcccccggggttcccccgtttacccccggggttacccgggttccccccgggtttccccccggttttaaccccggttaaacccgggtcccgggttaaccctccccgggtaacccggttaacccccggggtaagttaaccccgggaccccgtaccgggacccggttaacccccggggg

SEQ ID NO: 45154 - DNA, 487 bp, Homo sapiens
  misc_feature: GYAE6OF01DXE2L.35.61.F06.1.454.CMB.1.raw
  modified_base (462)..(462): a, c, t, g, unknown or other
  misc_feature (462)..(462): n is a, c, g, or t
  modified_base (479)..(487): a, c, t, g, unknown or other
  misc_feature (479)..(487): n is a, c, g, or t
tcagtacagatcgtcacgaccggtgctcgatttagctacgctctaagggaaagggagagtggagactgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctgggtcccagacagattcagcgccagtgggtcaggcactgacttcacactgaacatcagtagggtggaggctgaggatattgggatttatactgcatgcagggtacacactggccgttcacttttggccaggggaccaaggctggagatcaaacgaactgtggctgcaccatctgtcttcatcttcccgcatctgaacgtatctgtactgagcgggntcggcaaggcgcatagnnnnnnnnn

SEQ ID NO: 45155 - DNA, 481 bp, Homo sapiens
  misc_feature: GYAE6OF01E0G3F.35.61.F06.1.454.CMB.1.raw
  modified_base (366)..(366): a, c, t, g, unknown or other
  misc_feature (366)..(366): n is a, c, g, or t
  modified_base (469)..(469): a, c, t, g, unknown or other
  misc_feature (469)..(469): n is a, c, g, or t
  modified_base (473)..(481): a, c, t, g, unknown or other
  misc_feature (473)..(481): n is a, c, g, or t
tcagtacagatcgtcacgaccggtgctcgatttagctacgctctaagggaaagggagagtggagactgagtcatgactcagtctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggatttattactgcatgcagggtacacactggccgttnacttttggccaggggaccaagctggagatcaaacgaactgtggctgcacatctgtcttcatctccgcatctgacgatctgtactgagcgggctggcaaggcgnatgnnnnnnnnn
